(12) United States Patent
Govindarajan et al.

(10) Patent No.: US 9,169,467 B2
(45) Date of Patent: Oct. 27, 2015

(54) KETOL-ACID REDUCTOISOMERASE ENZYMES AND METHODS OF USE

(71) Applicant: BUTAMAX ADVANCED BIOFUELS, LLC, Wilmington, DE (US)

(72) Inventors: Sridhar Govindarajan, Los Altos, CA (US); Yougen Li, Pennington, NJ (US); Der-Ing Liao, Wilmington, DE (US); Daniel P. O'Keefe, Ridley Park, PA (US); Jeremy Stephen Minshull, Los Altos, CA (US); Steven Cary Rothman, Wilminton, DE (US); Alexander Vincent Tobias, Hockessin, DE (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 0 days.

(21) Appl. No.: 13/891,963

(22) Filed: May 10, 2013

(65) Prior Publication Data

US 2014/0051133 A1  Feb. 20, 2014

Related U.S. Application Data

(60) Provisional application No. 61/645,832, filed on May 11, 2012, provisional application No. 61/787,480, filed on Mar. 15, 2013.

(51) Int. Cl.
*C12N 9/04* (2006.01)
*C12P 7/16* (2006.01)

(52) U.S. Cl.
CPC ............ *C12N 9/0006* (2013.01); *C12P 7/16* (2013.01); *C12Y 101/01086* (2013.01); *Y02E 50/10* (2013.01)

(58) Field of Classification Search
None
See application file for complete search history.

(56) References Cited

U.S. PATENT DOCUMENTS

| | | | |
|---|---|---|---|
| 4,683,202 A | 7/1987 | Mullis | |
| 4,865,973 A | 9/1989 | Kollerup et al. | |
| 5,643,779 A | 7/1997 | Ehrlich et al. | |
| 6,586,229 B1 | 7/2003 | Ben-Bassat et al. | |
| 7,541,173 B2 | 6/2009 | Bramucci et al. | |
| 7,659,104 B2 | 2/2010 | Bramucci et al. | |
| 7,851,188 B2 | 12/2010 | Donaldson et al. | |
| 7,910,342 B2 | 3/2011 | Liao et al. | |
| 7,993,889 B1 | 8/2011 | Donaldson et al. | |
| 8,017,364 B2 | 9/2011 | Bramucci et al. | |
| 8,071,358 B1 | 12/2011 | Dundon et al. | |
| 8,129,162 B2 | 3/2012 | Li et al. | |
| 8,178,328 B2 | 5/2012 | Donaldson et al. | |
| 8,188,250 B2 | 5/2012 | Bramucci et al. | |
| 8,206,970 B2 | 6/2012 | Eliot et al. | |
| 8,222,017 B2 | 7/2012 | Li et al. | |
| 8,241,878 B2 | 8/2012 | Anthony et al. | |
| 8,273,558 B2 | 9/2012 | Donaldson et al. | |
| 8,283,144 B2 | 10/2012 | Donaldson et al. | |
| 8,372,612 B2 | 2/2013 | Larossa et al. | |
| 8,389,252 B2 | 3/2013 | Larossa | |
| 8,455,224 B2 | 6/2013 | Paul | |
| 8,455,225 B2 | 6/2013 | Bramucci et al. | |
| 8,465,964 B2 | 6/2013 | Anthony et al. | |
| 8,518,678 B2 | 8/2013 | Flint et al. | |
| 8,557,562 B2 | 10/2013 | Bramucci et al. | |
| 8,614,085 B2 | 12/2013 | Van Dyk et al. | |
| 8,637,281 B2 | 1/2014 | Paul et al. | |
| 8,637,289 B2 | 1/2014 | Anthony et al. | |
| 8,652,823 B2 | 2/2014 | Flint et al. | |
| 8,669,094 B2 | 3/2014 | Anthony et al. | |
| 8,691,540 B2 | 4/2014 | Bramucci et al. | |
| 8,735,114 B2 | 5/2014 | Donaldson et al. | |
| 8,765,433 B2 | 7/2014 | Gude et al. | |
| 8,785,166 B2 | 7/2014 | Anthony | |
| 8,795,992 B2 | 8/2014 | Bramucci et al. | |
| 8,828,694 B2 | 9/2014 | Anthony et al. | |
| 8,828,704 B2 | 9/2014 | Donaldson et al. | |
| 8,871,488 B2 | 10/2014 | Dauner et al. | |
| 8,889,385 B2 | 11/2014 | Donaldson et al. | |
| 8,895,307 B2 | 11/2014 | Li et al. | |
| 8,906,666 B2 | 12/2014 | Alsaker et al. | |
| 8,911,981 B2 | 12/2014 | Li et al. | |
| 8,940,511 B2 | 1/2015 | Larossa | |
| 8,945,859 B2 | 2/2015 | Donaldson et al. | |
| 8,945,899 B2 | 2/2015 | Li et al. | |
| 8,951,774 B2 | 2/2015 | Donaldson et al. | |
| 8,951,937 B2 | 2/2015 | Flint et al. | |
| 8,956,850 B2 | 2/2015 | Anthony et al. | |
| 8,962,298 B2 | 2/2015 | Donaldson et al. | |
| 8,969,065 B2 | 3/2015 | Anthony et al. | |
| 8,980,612 B2 | 3/2015 | Donaldson et al. | |
| 2002/0061569 A1 | 5/2002 | Haselbeck et al. | |
| 2004/0234649 A1 | 11/2004 | Lewis et al. | |
| 2004/0248250 A1 | 12/2004 | Nakai et al. | |
| 2005/0112739 A1 | 5/2005 | Golubkov et al. | |
| 2007/0031918 A1 | 2/2007 | Dunson et al. | |
| 2007/0092957 A1 | 4/2007 | Donaldson et al. | |
| 2007/0259411 A1 | 11/2007 | Bramucci et al. | |
| 2008/0182308 A1 | 7/2008 | Donaldson et al. | |

(Continued)

FOREIGN PATENT DOCUMENTS

| | | |
|---|---|---|
| WO | WO9408020 | 4/1994 |
| WO | WO0112833 | 2/2001 |

(Continued)

OTHER PUBLICATIONS

Chica et al. Curr Opin Biotechnol. Aug. 2005;16(4):378-84.*

(Continued)

*Primary Examiner* — Christian Fronda

(57) ABSTRACT

Provided herein are polypeptides having ketol-aid reductoisomerase activity as well as microbial host cells comprising such polypeptides. Polypeptides provided herein may be used in biosynthetic pathways, including, but not limited to, isobutanol biosynthetic pathways.

12 Claims, 13 Drawing Sheets

(56) References Cited

U.S. PATENT DOCUMENTS

| | | |
|---|---|---|
| 2008/0261230 A1 | 10/2008 | Liao et al. |
| 2009/0081746 A1 | 3/2009 | Liao et al. |
| 2009/0163376 A1 | 6/2009 | Li et al. |
| 2009/0269823 A1 | 10/2009 | Bramucci et al. |
| 2009/0305363 A1 | 12/2009 | Anthony et al. |
| 2010/0081154 A1 | 4/2010 | Flint et al. |
| 2010/0081179 A1 | 4/2010 | Anthony et al. |
| 2010/0081182 A1 | 4/2010 | Paul et al. |
| 2010/0081183 A1 | 4/2010 | Paul et al. |
| 2010/0093020 A1 | 4/2010 | Bramucci et al. |
| 2010/0112655 A1 | 5/2010 | Paul et al. |
| 2010/0120105 A1 | 5/2010 | Anthony et al. |
| 2010/0129887 A1 | 5/2010 | Anthony et al. |
| 2010/0143997 A1 | 6/2010 | Buelter et al. |
| 2010/0197519 A1 | 8/2010 | Li et al. |
| 2011/0076733 A1 | 3/2011 | Urano et al. |
| 2011/0111472 A1 | 5/2011 | Donaldson et al. |
| 2011/0124060 A1 | 5/2011 | Anthony et al. |
| 2011/0136192 A1 | 6/2011 | Paul et al. |
| 2011/0195505 A1 | 8/2011 | Euler et al. |
| 2011/0244536 A1 | 10/2011 | Nagarajan et al. |
| 2011/0250610 A1 | 10/2011 | Bramucci et al. |
| 2011/0275129 A1 | 11/2011 | Buelter et al. |
| 2012/0058541 A1 | 3/2012 | Alsaker et al. |
| 2012/0064561 A1 | 3/2012 | Flint et al. |
| 2012/0149080 A1 | 6/2012 | Bramucci et al. |
| 2012/0196341 A1 | 8/2012 | Donaldson et al. |
| 2012/0237988 A1 | 9/2012 | Anthony et al. |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0171706 A1 | 7/2013 | Donaldson et al. |
| 2013/0203138 A1 | 8/2013 | McElvain et al. |
| 2013/0252296 A1 | 9/2013 | Maggio-Hall et al. |
| 2013/0316414 A1 | 11/2013 | Paul et al. |
| 2013/0344551 A1 | 12/2013 | Li et al. |
| 2014/0004526 A1 | 1/2014 | Dauner et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051137 A1 | 2/2014 | Flint et al. |
| 2014/0057329 A1 | 2/2014 | Li et al. |
| 2014/0093930 A1 | 4/2014 | Li et al. |
| 2014/0096439 A1 | 4/2014 | Bramucci,et al.. |
| 2014/0141479 A1 | 5/2014 | Anthony et al. |
| 2014/0170732 A1 | 6/2014 | Bramucci,et al. |
| 2014/0186910 A1 | 7/2014 | Rothman et al. |
| 2014/0186911 A1 | 7/2014 | Anthony et al. |
| 2014/0273116 A1 | 9/2014 | Kelly et al. |
| 2014/0273129 A1 | 9/2014 | Bhalla et al. |
| 2014/0308735 A1 | 10/2014 | Anthony et al. |
| 2014/0335582 A1 | 11/2014 | Donaldson et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |

FOREIGN PATENT DOCUMENTS

| | | |
|---|---|---|
| WO | WO2005040392 | 5/2005 |
| WO | WO2008098227 | 8/2008 |
| WO | WO2008130995 | 10/2008 |
| WO | WO2009056984 | 5/2009 |
| WO | WO2009059253 | 5/2009 |
| WO | WO2009078108 | 6/2009 |
| WO | WO2009086423 | 7/2009 |
| WO | WO2010051527 | 5/2010 |

OTHER PUBLICATIONS

Sen et al. Appl Biochem Biotechnol. Dec. 2007;143(3):212-23.*

Abbad-Andaloussi, et al., Carbon and Electron Flow in Clostridium butyricum grown in Chemostat Culture on Glycerol and on Glucose, Microbiology 142:1149-1158, 1996.

Arthur, et al., Contribution of VanY D,D-Carboxypeptidase to Glycopeptide Resistance in *Enterococcus faecalis* by Hydrolysis of Peptidoglycan Precursors, Antimicrob. Agents Chemother. 38:1899-1903, 1994.

Aulabaugh, et al., Oxalyl Hydroxamates as Reaction-Intermediate Analogues for Ketol-Acid Reductoisomerase, Biochemistry 29:2824-2830 1990.

Biou, et al. The crystal structure of plant acetohydroxy acid isomeroreductase complexed with NADPH, two magnesium ions and a herbicidal transition state analog determined at 1.65 Å resolution, EMBO Journal 16:3405-3415, 1997.

van der Geize, et al., Targeted Disruption of the kstD Gene Encoding a 3-Ketosteroid delta1-Dehydrogenase Isoenzyme of *Rhodococcus erythropolis* Strain SQ1, Appl. Environ. Microbiol. 66:2029-2036, 2000.

Chunduru, et al., Mechanism of Ketol Acid Reductoisomerase— Steady State Analysis and Metal Ion Requirement, Biochemistry 28:486-493 1989.

de Cavalho, et al., Mycobacterium sp., *Rhodococcus erythropolis*, and *Pseudomonas putida* Behavior in the Presence of Organic Solvents, Microsc. Res. Tech. 64:215-22, 2004.

de la Plaza, et al., Biochemical and molecular characterization of alpha-ketoisovalerate decarboxylase, an enzyme involved in the formation of aldehydes from amino acids by *Lactococcus lactis*, Fems Microbiol. Lett. 238:367-374, 2004.

Deshpande, Ethanol Production from Cellulose by Coupled Saccharification/Fermentation using *Saccharomyces cerevisiae* and Cellulase Complex from *Sclerotium rolfsii* UV-8 Mutant, Appl. Biochem. Biotechnol. 36:227, 1992.

Dürre, et al., Solventogenic Enzymes of *Clostridium acetobutylicum*: Catalytic Properties, Genetic Organization, and Transcriptional Regulation, FEMS Microbiol. Rev. 17:251-262, 1995.

Dürre, New insights and novel developments in clostridial acetone/butanol/isopropanol fermentationAppl. Microbiol. Biotechnol. 49:639-648, 1998.

Eichenbaum, et al., Use of the Lactococcal nisA Promoter to Regulate Gene Expression in Gram-Positive Bacteria: Comparison of Induction Level and Promoter Strength, Appl. Environ. Microbiol. 64:2763-2769, 1998.

Fleming, et al., Extracellular Enzyme Synthesis in a Sporulation-Deficient Strain of *Bacillus licheniformis*, Appl. Environ. Microbiol. 61:3775-3780, 1995.

Flint, et al., The Role and Properties of the Iron-Sulfur Cluster in *Escherichia coli* Dihydroxy-acid Dehydratase, J. Biol. Chem. 268:14732-14742, 1993.

Ford, et al., Characterization of Ypr1p from *Saccharomyces cerevisiae* as a 2-methylbutyraldehyde reductase, Yeast 19:1087-1096, 2002.

Fujimoto, et al., pAM401-Based Shuttle Vectors That Enable Overexpression of Promoterless Genes and One-Step Purification of Tag Fusion Proteins Directly from *Enterococcus faecalis*, Appl. Environ. Microbiol. 67:1262-1267, 2001.

Gollop, et al., Physiological Implications of the Substrate Specificities of Acetohydroxy Acid Synthases from Varied Organisms, J. Bacteriol. 172:3444-3449, 1990.

Groot, et al., Technologies for Butanol Recovery Integrated with Fermentations, Process. Biochem. 27:61-75, 1992.

Guex, et al., Swiss-Model and the Swiss-PdbViewer: An Environment for Comparative Protein Modeling, Electrophoresis 18:2714-2723, 1997.

Hermann, et al., Isolation and Characterization of Butanol-Resistant Mutants of *Clostridium acetobutylicum*, Appl. Environ. Microbiol. 50:1238-1243, 1985.

Holtzclaw, et al., Degradative Acetolactate Synthase of *Bacillus subtilis*: Purification and Properties, J. Bacteriol. 121:917-922, 1975.

Jones, et al., Improved Methods for Building Protein Models in Electron Density Maps and the Location of Errors in these Models, Acta Crystallogr. A 47:110-119, 1991.

Kabelitz, et al., Effect of aliphatic alcohols on growth and degree of saturation of membrane lipids in *Acinetobacter calcoaceticus*, FEMS Microbiol. Lett. 220: 223-227, 2003.

(56) References Cited

OTHER PUBLICATIONS

Datsenko, et al., One-step inactivation of chromosomal genes in *Escherichia coli* K-12 using PCR products, Proc. Natl. Acad. Sci. USA 97:6640-6645, 2000.
Kleerebezem, et al., Controlled Gene Expression Systems for Lactic Acid Bacteria: Transferable Nisin-Inducible Expression Cassettes for *Lactococcus, Leuconostoc,* and *Lactobacillus* spp., Appl. Environ. Microbiol. 63:4581-4584, 1997.
Kostichka, et al., A small cryptic plasmid from *Rhodococcus erythropolis* : characterization and utility for gene expressionAppl. Microbiol. Biotechnol. 62:61-68, 2003.
Krogh, et al., Hidden Markov Models in Computational Biology, J. Mol. Biol. 235:1501-1531, 1994.
Larroy, et al., Characterization of the *Saccharomyces cerevisiae* YMR318C (ADH6) gene product as a broad specificity NADPH-dependent alcohol dehydrogenase: relevance in aldehyde reduction, Biochem. J. 361:163-172, 2002.
Maguin, et al., New Termosensitive Plasmid for Gram-Positive Bacteria, J. Bacteriol. 174:5633-5638, 1992.
Marinus, et al., Regulation of Isoleucine-Valine Biosynthesis in *Pseudomonas aeruginosa*, Genetics 63:547-56, 1969.
Nagarajan, et al., Modular Expression and Secretion Vectors for *Bacillus subtilis*, Gene 114:121-126, 1992.
Nakashima, et al., Isolation and Characterization of a Rolling-Circle-Type Plasmid from *Rhodococcus erythropolis* and Application of the Plasmid to Multiple-Recombinant-Protein Expression, Appl. Environ. Microbiol. 70:5557-5568, 2004.
Nallaapareddy, et al., Construction of Improved Temperature-Sensitive and Mobilizable Vectors and Their Use for Constructing Mutations in the Adhesin-Encoding acm Gene of Poorly Transformable Clinical *Enterococcus faecium* Strains, Appl. Environ. Microbiol. 72:334-345, 2006.
O'Sullivan, et al., High- and low-copy-number *Lactococcus* shuttle cloning vectors with features for clone screening, Gene 137:227-231, 1993.
Payne, et al., Use of Alkaline Phosphatase Fusions to Study Protein Secretion in *Bacillus subtilis*, J. Bacteriol. 173:2278-2282, 1991.
Renault, et al., Plasmid Vectors for Gram-positive Bacteria Swithching from High to Low Copy Number, Gene 183:175-182, 1996.
Scott, et al., Sequences of versatile broad-host-range vectors of the RK2 family, Plasmid 50:74-79, 2003.
Smit, et al., Identification, Cloning, and Characterization of a *Lactococcus lactis* Branched-Chain alpha-Keto Acid Decarboxylase Involved in Flavor Formation, Appl. Environ. Microbiol. 71:303-311, 2005.
Sulter, et al., Proliferation and metabolic significance of peroxisomes in *Candida boidinii* during drowth on D-alanine or oleic acid as the sole carbon source, Arch. Microbiol. 153:485 489, 1990.
Sulzenbacher, et al., Crystal Structure of *E. coli* Alcohol Dehydrogenase YqhD: Evidence of a Covalently Modified NADP Coenzyme, J. Mol. Biol. 342:489-502, 2004.
Tabor, et al., A bacteriophage T7 RNA polymerase/promoter system for controlled exclusive expression of specific genes, Proc. Acad. Sci. USA 82:1074, 1985.
Taghavi, et al., Electroporation of *Alcaligenes eutrophus* with (Mega) Plasmids and Genomic DNA Fragments, Appl. Environ. Microbiol. 60:3585-3591, 1994.
Tanimoto, et al., Analysis of the Conjugal Transfer System of the Pheromone-Independent Highly Transferable *Enterococcus* Plasmid pMG1: Identification of a tra Gene (traA) Up-Regulated during Conjugation, J. Bacteriol. 184:5800-5804, 2002.
Tao, et al., Construction of highly efficient *E. coli* expression systems containing low oxygen induced promoter and partition region, Appl. Microbiol. Biotechnol. 68:346-354, 2005.
Thompson, et al., Clustal W: improving the sensitivity of progressive multiple sequence alignment through sequence weighting, position-specific gap penalties and weight matrix choice, Nuc. Acid Res. 22:4673-4680, 1994.
Tomas, et al., Transcriptional Analysis of Butanol Stress and Tolerance in *Clostridium acetobutylicum*, J. Bacteriol. 186:2006-2018, 2004.
Tyagi, et al., The crystal structure of a bacterial Class II ketol-acid reductoisomerase: Domain conservation and evolution, Protein Sci. 14:3089-3100, 2005.
van Kranenburg, et al., Functional Analysis of Three Plasmids from *Lactobacillus plantarum*, Appl. Environ. Microbiol. 71:1223-1230, 2005.
Walker, et al., Isothermal in vitro amplification of DNA by a restriction enzyme/DNA polymerase systemProc. Natl. Acad. Sci. U.S.A. 89:392-396, 1992.
Wyckoff, et al., Characterization and Sequence Analysis of a Stable Cryptic Plasmid from *Enterococcus faecium* 226 and Development of a Stable Cloning Vector, Appl. Environ. Microbiol. 62:1481-1486, 1996.
Dumas, et al., Purification and characterization of a fusion protein of plant acetohydroxy acid synthase and acetohydroxy acid isomeroreductase, FEBS Lett. 408:156-160, 1997.
Bellion et al., Microb. Growth C1 Compd., [Int. Symp.], 7th (1993), 415 32. (eds): Murrell, J. Collin; Kelly, Don P. Publisher: Intercept, Andover, UK.
Dumas, et al., Isolation and kinetic properties of acetohydroxy acid isomeroreductase from spinach (*Spinacia oleracea*) chloroplasts overexpressed in *Escherichia coli*, Biochem. J. 288:865-874, 1992.
Epelbaum, et al. Branched-chain amino acid biosynthesis in *Salmonella* typhimurium: a quantitative analysis, J. Bacteriol. 180:4056-4067, 1998.
Kuzuyama, Mevalonate and nonmevalonate pathways for the biosynthese of isoprene units, Biosci. Biotechnol. Biochem. 66:1619-1627, 2002.
Garcia, et al. Fusel alcohols production in beer fermentation processes, Proc. Biochem. 29:303-309,1994.
Carlini, et al., Guerbet condensation of methanol with n-propanol to isobutyl alcohol over heterogeneous copper chromite/Mg-Al mixed oxides, J. Mol. Catalysis A 220:215-220, 2004.
Rothstein, Targeting, disruption, replacement, and allele rescue: integrative DNA transformation in yeast, Meth. Enzymol. 194:281-301, 1991.
Horton, et al., Engineering hybrid genes without the use of restriction enzymes: gene splicing by overlap extension, Gene 77:61-68, 1989.
Kaneko, et al., Complete Genome Sequence of the Filamentous Nitrogen-fixing Cyanobacterium *Anabaena* sp. strain PCC 7120, DNA Res. 8:205-213, 227-253, 2001.
Dickinson, et al., An Investigation of the Metabolism to Isobutyl Alcohol in *Saccharomyces Cerevisiae*, J. Biol. Chem. 273:25752-25756, 1998.
Oaxaca, et al., Formation of Ethanol and Higher Alcohols by Immobilized *Zymomonas mobilis* in Continuous Culture, ACTA Biotechnol. 11:523-532, 1991.
Eppink, et al., Switch of Coenzyme Specificity of p-Hydroxybenzoate Hydroxylase, J. Mol. Biol. 292:87-96, 1999.
Nakanishi, et al., Switch of Coenzyme Specificity of Mouse Lung Carbonyl Reductase by Substitution of Threonine 38 with Aspartic Acid, J. Biol. Chem. 272:2218-2222, 1997.
Kamerbeek, et al., Identifying Determinants of NADPH Specificity in Baeyer-Villiger Monooxygenases, Eur. J. Biochem. 271:2107-2116, 2004.
Nishiyama, et al., Alteration of Coenzyme Specificity of Malate Dehydrogenase from *Thermus flavus* by Site-directed Mutagenesis, J. Biol. Chem. 268:4656-4660, 1993.
Martinez-Julvez, et al., Towards a New Interaction Enzyme: Coenzyme, Biophys. Chem. 115:219-224, 2005.
Rane, et al., Reversal of the Nucleotide Specificity of Ketol Acid Reductoisomerase by Site-Directed Mutagenesis Identifies the NADPH Binding Site, Archiv. Biochem. Biophys. 338:83-89, 1997.
Ahn, et al., Crystal Structure of Class I Acetohydroxy Acid Isomeroreductase from *Pseudomonas aeruginosa*, J. Mol. Biol. 328:505-515, 2003.
Paulsen, et al., Complete genome sequence of the plant commensal *Pseudomonas fluorescens* Pf-5, Nature Biotechnol. 23:8730878, 2005.

(56) References Cited

OTHER PUBLICATIONS

Carugo, et al., NADP-Dependent Enzymes I: Conserved Stereochemistry of Cofactor Binding, Proteins: Structure, Function, and Genetics 28:10-28, 1997.
Dumas, et al., Enzymology, Structure, and Dynamics of Acetohydroxy Acid Isomeroreductase, Acc. Chem. Res. 34:399-408, 2001.
Elmore, et al., Modification of the Nucleotide Cofactor-binding Site of Cytochrome P-450 Reductase to Enhance Turnover with NADH in vivo, J. Biol. Chem. 277:48960-48964, 2002.
Fisher, et al., The X-ray Structure of *Brassica napus* beta-keto acyl carrier protein reductase and its implication for substrate binding and catalysis, Structure 8:339-347, 2000.
Khoury, et al., Computational design of *Candida boidinii* xylose reductase for altered cofactor specificity, Protein Sci. 18:2125-2136, 2009.
Kuzuyama, et al., Characterization of 1-deoxy-D-xylulose 5-Phosphate Reductoisomerase, an Enzyme Involved in Isopentenyl Diphosphate Biosynthesis, and Identification of Its Catalytic Amino Residues, J. Biol. Chem. 275:19928-19932, 2000.
Medina, et al., Probing the Determinants of Coenzyme specificity in Ferredoxin-NADP+ Reductase by Site-directed Mutagenesis, J. Biol. Chem. 276:11902-11912, 2001.
Wierenga, et al., Prediction of the Occurence of the SDP-binding Beta-alpha-beta Fold in Proteins, Using an Amino Acid Sequence Fingerprint, J. Mol. Biol. 187:101-107, 1986.
Brinkmann-Chen, et al., General approach to reversing ketol-acid reductoisomerase cofactor dependence from NADPH to NADH, Proc. Natl. Acad. Sci. 110:10946-10951, 2013.
Rossmann, et al., Chemical and biological evolution of nucleotide-binding protein, Nature 250:194-199, 1974.
Curien, et al., Nucleotide sequence and characterization of a cDNA encoding the Acetohydroxy acid isomeroreductase from *Arabidopsis thaliana*, Plant Molecular Biology 21:717-722, 1993.
Dumas, et al., Purification and characterization of acetohydroxyacid reductoisomerase from spinach chloroplasts, Biochem. J. 262:971-976, 1989.
Durner, et al., Ketol-Acid Reductoisomerase from Barley (*Hordeum vulgare*): Purification, Properties, and Specific Inhibition, Plant Physiol. 103:903-910, 1993.
Feeney, et al., A single amino acid substitution in lactate dehydrogenase improves the catalytic efficiency with an alternative coenzyme, Biochem. Biophys. Res. Commun. 166:667-672, 1990.
Inui, et al., Identification and sequence determination of the acetohydroxy acid isomeroreductase gene from *Brevibacterium flavum* MJ233, DNA Seq. 4:95-103, 1993 (Abstract).
Lauvergeat, et al., Site-directed mutagenesis of a serine residue in cinnamyl alcohol dehydrogenase, a plant NADPH-dependent dehydrogenase, affects the specificity for the coenzyme, Biochemistry 34:12426-12434, 1995.
Levskaya, et al., Synthetic biology: engineering *Escherichia coli* to see light, Nature 438:441-442, 2005.
Shiraishi, et al., Engineering of pyridine nucleotide specificity of nitrate reductase: mutagenesis of recombinant cytochrome b reductase fragment of *Neurospora crassa* NADPH:Nitrate reductase, Archives of Biochemistry and Biophysics 358:104-115, 1998.
Tyagi, et al., Probing the mechanism of the bifunctional enzyme ketol-acid reducoisomerase by site-directed mutagenesis of the active site, FEBS Journal 272:593-602, 2005.
Zhang, et al., Change of nucleotide specificity and enhancement of catalytic efficiency in single point mutants of Vibrio harveyi aldehyde dehydrogenase, Biochemistry 38:11440-11447, 1999.
Rud, et al., A synthetic promoter library for constitutive gene expression in *Lactobacillus plantarum*, Microbiol. 152:1011-1019, 2006.
Vasantha, et al., Genes for Alkaline Protease and Neutral Protease from *Bacillus amyloliquefaciens* Contain a Large Open Reading Frame Between the Regions Coding for Signal Sequence and Mature Protein, J. Bacteriol., 159:811-819, 1984.
Pearson, Comput. Methods Genome Res., [Proc. Int. Symp.] (1994), Meeting Date 1992, 111-20. Editor(s): Suhai, Sandor. Plenum: New York, NY.
Yuan, et al., Regulation of groE Expression In *Bacillus subtills*: the Involvement of the cr-Like Promoter and the Roles of the Inverted Repeat Sequence (Circe), J. Bacteriol. 177:5427-5433, 1995.
Yansura, et al., Use of the *Escherichia coli* lac repressor and operator to control gene expression in *Bacillus subtilis*, Proc. Natl. Acad. Sci. USA, vol. 81:439-443, 1984.
Johnson, et al., DNA sequences at the ends of transposon Tn5 required for transposition, Nature 304:280-282, 1983.
Higgins et al., Fast and sensitive multiple sequence alignments on a microcomputer, CABIOS Communications 5:151-153, 1989.
Higgins, et al., CLUSTAL V: improved software for multiple sequence alignment, CABIOS 8:189-191, 1992.
Horinouchi, et al., Nucleotide sequence and functional map of pE194, a plasmid that specifies inducible resistance to macrolide, lincosamide, and streptogramin type B antibiotics, J. Bacteriol. 150:804-814, 1982.
International Search Report dated Dec. 17, 2013 for International Application No. PCT/US2013/040627.
Godon. et al., Branched-chain amino acid biosynthesis genes in Lactococcus lactic subsp. lactis , J. Bacteriol. 174:6580-6589, 1992.
Ferain, et al., *Lactobacillus plantarum* IdhL gene: overexpression and deletion, J. Bacteriol. 176:596-601, 1994.
GenBank No. NC_009135.1, *Methanococcus maripaludis* C5, complete genome, Apr. 30, 2009.
GenBank No. NC_005791.1, *Methanococcus maripaludis* S2, complete genome, Apr. 25, 2009.
GenBank No. NZ_AAWX01000002.1, *Methanococcus vannielii* Sb ctg6, whole genome shotgun sequence, Feb. 7, 2007.
GenBank No. NC_001144.4, *Saccharomyces cerevisiae* chromosome Xii, complete sequence, Jun. 16, 2008.
GenBank No. NC_002754.1, *Sulfolobus solfataricus* P2, complete genome, Apr. 26, 2009.
GenBank No. NC_003364.1, *Pyrobaculum aerophilum* str. IM2, complete genome, Apr. 24, 2009.
GenBank No. AAA25079, acetolactate synthase [*Klebsiella pneumoniae*], Aug. 5, 1994.
GenBank No. AAA25161, alpha-acetolactate synthase, Apr. 21, 1994.
GenBank No. AAA65614, keto acid dehydrogenase E1-alpha subunit [*Pseudomonas putida*] Feb. 27, 2002.
GenBank No. AAA65615, 39 kDa keto acid dehydrogenase E1-beta subunit [*Pseudomonas putida*], Feb. 27, 2002.
GenBank No. AAA65617, transacylase E2 [*Pseudomonas putida*], Feb. 27, 2002.
GenBank No. AAA65618, lipoamide dehydrogenase [*Pseudomonas putida*], Feb. 27, 2002.
GenBank No. AAS49166, branched-chain alpha-ketoacid decarboxylase [*Lactococcus lactis*], Dec. 27, 2004.
GenBank No. AJ746364, *Lactococcus lactis* subsp. lactis kivd gene for alpha-ketoisovalerate decarboxylase, strain IFPL730, Apr. 15, 2005.
GenBank No. AY548760, *Lactococcus lactis* branched-chain alpha-ketoacid decarboxylase (kdcA) gene, complete cds. Dec. 27, 2004.
GenBank No. BX950229, *Methanococcus maripaludis* strain S2, complete sequence, May 8, 2008.
GenBank No. CAB14105, dihydroxy-acid dehydratase [*Bacillus subtilis* subsp. *subtilis* str, Oct. 1, 2009.
GenBank No. CAB14334, branched-chain alpha-keto acid dehydrogenase E2 subunit (lipoamide acyltransferase) [*Bacillus subtilis* subsp. *subtilis* str. 168], Oct. 1, 2009.
GenBank No. CAB14335, branched-chain alpha-keto acid dehydrogenase El subunit [*Bacillus subtilis* subsp. *subtilis* str. 168], Oct. 1, 2009.
GenBank No. CAB14336, branched-chain alpha-keto acid dehydrogenase El subunit [*Bacillus subtilis* subsp. *subtilis* str. 168], Oct. 1, 2009.
GenBank No. CAB14337, branched-chain alpha-keto acid dehydrogenase E3 subunit (dihydrolipoamide dehydrogenase) [*Bacillus subtilis* subsp. *subtilis* str. 168], Oct. 1, 2009.

(56) References Cited

OTHER PUBLICATIONS

GenBank No. CAB15618, alpha-acetolactate synthase [*Bacillus subtilis* subsp. *subtilis* str. 168], Oct. 1, 2009.
GenBank No. CAF29874, Dihydroxy-acid dehydratase [*Methanococcus maripaludis* S2], May 8, 2008.
GenBank No. CAG34226, alpha-ketoisovalerate decarboxylase [*Lactococcus lactis* subsp. *lactis*], Apr. 15, 2005.
GenBank No. L16975, *Lactococcus lactis* alpha-acetolactate synthase (als) gene, complete cds, Apr. 21, 1994.
GenBank No. M57613, *Pseudomonas putida* branched-chain keto acid dehydrogenase operon (bkdA1, bkdA1 and bkdA2), transacylase E2 (bkdB), bkdR and lipoamide dehydrogenase (lpdV) genes, complete cds. Feb. 27, 2002.
GenBank No. M73842, *Klebsiella pneumoniae* acetolactate synthase (iluk) gene, complete cds, Aug. 5, 1994.
GenBank No. NC_001142, *Nosema ceranae* BRLO1 Nc001142, whole genome shotgun sequence, Jun. 9, 2009.
GenBank No. NC_003030, *Clostridium acetobutylicum* ATCC 824, complete genome, Oct. 22, 2009.
GenBank No. NC_001136, *Saccharomyces cerevisiae* chromosome IV, complete sequence, Dec. 9, 2009.
GenBank No. NC_001145, *Saccharomyces cerevisiae* chromosome XIII, complete sequence, Dec. 9, 2009.
GenBank No. NC_001988, *Clostridium acetobutylicum* ATCC 824 plasmid pSOL1, complete sequence, Apr. 26, 2009.
GenBank No. NC_003197, *Salmonella typhimurium* LT2, complete genome, Mar. 30, 2010.
GenBank No. NP_012550, Dihydroxyacid dehydratase, catalyzes third step in the common pathway leading to biosynthesis of branchedchain amino acids; 11v3p [*Saccharomyces cerevisiae*], Nov. 5, 2009.
GenBank Accession No. B9CVH4, Ketol-acid reductoisomerase, Feb. 8, 2011.
GenBank No. NP_014051, Adh6p [*Saccharomyces cerevisiae*], Dec. 9, 2009.
GenBank No. NP_149189, pyruvate decarboxylase [*Clostridium acetobutylicum* ATCC 824], Apr. 26, 2009.
GenBank No. NP_349892, NADH-dependent butanol dehydrogenase A (BDH I) [*Clostridium acetobutylicum* ATCC 824], Apr. 14, 2010.
GenBank No. NP_417484, alcohol dehydrogenase, NAD(P)-dependent [*Escherichia coli* str. K-12 substr. MG1655]. Apr. 9, 2010.
GenBank No. NP_461346, indolepyruvate decarboxylase [*Salmonella typhimurium* LT2], Apr. 30, 2009.
GenBank No. YP_026248, dihydroxyacid dehydratase [*Escherichia coli* str. K-12 substr. MG1655], Jul. 30, 2009.
GenBank No. Z99115, *Bacillus subtilis* complete genome (section 12 of 21): from 2207806 to 2409180, Nov. 15, 2007.
GenBank No. AL009126, *Bacillus subtilis* subsp. *subtilis* str. 168 complete genome, Oct. 1, 2009.
GenBank No. Z99122, *Bacillus subtilis* complete genome (section 19 of 21): from 3608981 to 3809670, Apr. 18, 2005.
GenBank No. ZP01224863.1, ketol-acid reductoisomerase [marine gamma proteobacterium HTCC2207], Mar. 24, 2006.
GenBank No. NC_003295.1, *Ralstonia solanacearum* GMI1000, complete genome, May 1, 2009.
GenBank No. NC_002516, *Pseudomonas aeruginosa* PA01, Jul. 20, 2008.
GenBank No. NC_004129, *Pseudomonas fluorescens* Pf-5, Jul. 20, 2008.
GenBank No. ZP_01313517.1, ketol-acid reductoisomerase [*Desulfuromonas acetoxidans* DSM 684], May 15, 2006.
GenBank No. O82043, Ketol-acid reductoisomerase, chloroplastic, Jun. 16, 2009.
GenBank No. NP_977840.1, ketol-acid reductoisomerase [*Bacillus cereus* ATCC 10987], May 1, 2009.
GenBank No. NP_978252.1, ketol-acid reductoisomerase [*Bacillus cereus* ATCC 10987], May 1, 2009.
GenBank No. P05793, Ketol-acid reductoisomerase, Jun. 16, 2009.
GenBank No. Q6F821, ketol-acid reductoisomerase, Oct. 2004.
GenBank Accession No. Q4K608, ketol-acid reductoisomerase. *Pseudomonas fluorescens*, Aug. 2, 2005.
GenBank Accession No. NC_000913, *Escherichia coli* str. K-12 substr. MG1655, May 17, 2008.
Kumanovics, et al. Identification of FRA1 and FRA2 as genes involved in regulating the yeast iron regulon in response to decreased mitochondrial iron-sulfur cluster synthesis. J. Biol. Chem. 283:10276-10286, 2008.
Davison, et al. Continuous Direct Solvent Extration of Butanol in a Fermenting Fluidized-Bed Bioreactor with Immobilized *Clostridium acetobutylicum*. Appl. Biochem. Biotech. 39/40:415-426, 1993.
Altschul, et al., Basic Local Alignment Search Tool, J. Mol. Biol. 215:403-410, 1990.
Spano, et al., Environmental stress response in wine lactic acid bacteria: beyond *Bacillus subtilis*, Crit. Rev. Microbiol. 32:77-86, 2006.
Chang, et al., Construction and Characterization of Amplifiable Multicopy DNA Cloning Vehicles Derived fom the P15A Cryptic Miniplasmid, J. Bacteriol. 134:1141-1156, 1978.
Methods in Yeast Genetics, 2005, Cold Spring Harbor Laboratory Press, Cold Spring Harbor, NY, pp. 201-202.
Butanols, Ullman's Encyclopedia of Industrial Chemistry, 6th Edition, 5:716-719, 2003.
GenBank Accession No. NC_002505, *Vibrio cholerae* O1 biovar eltor str. N16961, Jul. 21, 2008.
GenBank Accession No. AAU36450, *Psuedomonas aeruginosa* cellular proliferation protein. Feb. 14, 2002.
GenBank Accession No. A3EGY6, ketol-acid reductoisomerase, *Vibrio chlorea*, Mar. 20, 2007.
U.S. Appl. No. 14/571,817, filed Dec. 16, 2014 (Butamax).
U.S. Appl. No. 14/585,261, filed Dec. 30, 2014 (Butamax).

\* cited by examiner

KETOL-ACID REDUCTOISOMERASE ENZYMES AND METHODS OF USE

CROSS-REFERENCE TO RELATED APPLICATIONS

This application is related to and claims the benefit of priority to U.S. Provisional Patent Application No. 61/645,832 filed on May 11, 2012 and U.S. Patent Application No. 61/787,480 filed on Mar. 15, 2013, both of which are herein incorporated by reference in their entireties.

GOVERNMENT LICENSE RIGHTS

This invention was made with Government support under Agreement DE-AR0000006 awarded by the United States Department of Energy. The Government has certain rights in this invention.

FIELD OF THE INVENTION

The invention relates to polypeptides comprising ketol-acid reductoisomerase activity, polynucleotides encoding such polypeptides, host cells comprising such polynucleotides and polypeptides, and methods of using such compositions.

REFERENCE TO SEQUENCE LISTING SUBMITTED ELECTRONICALLY VIA EFS-WEB

The content of the Sequence Listing submitted electronically herewith (Name: CL5631USNP_SEQLIST.txt; Size: 1,036,487 bytes; Date of Creation: Sep. 18, 2013) is herein incorporated by reference in its entirety.

BACKGROUND OF THE INVENTION

Ketol-acid reductoisomerase (KARI) enzymes are involved in the biological production of valine and isoleucine. KARI enzymes have also been shown to be useful for pathways for the production of isobutanol using engineered microorganisms (U.S. Pat. Nos. 7,851,188 and 7,993,889). Such microorganisms can be used to produce isobutanol from plant-derived substrates.

While methods for the chemical synthesis of isobutanol are known (oxo synthesis, catalytic hydrogenation of carbon monoxide (Ullmann's Encyclopedia of Industrial Chemistry, 6th edition, 2003, Wiley-VCH Verlag GmbH and Co., Weinheim, Germany, Vol. 5, pp. 716-719) and Guerbet condensation of methanol with n-propanol (Carlini et al., J. Molec. Catal. A. Chem. 220215-220, 2004)), these processes use starting materials derived from petrochemicals and are generally expensive. Furthermore, chemical synthesis of isobutanol does not have the potential for environmental advantages such as minimization of green house gas emissions. Production of isobutanol from plant-derived raw materials would represent an advance in the art.

A KARI enzyme that can utilize reduced nicotinamide adenine dinucleotide (NADH) can capitalize on the NADH produced by the existing glycolytic pathway and other metabolic pathways in commonly used microbial cells and may result in improved isobutanol production. U.S. Pat. No. 8,129,162 and US Appl. Pub. No. 2010/0197519A1 describe the generation of KARI enzymes with varying abilities to utilize the cofactor (NADH). However, there remains a need in the art for alternative polypeptides that have KARI activity suitable for production pathways such as isobutanol biosynthetic pathways.

SUMMARY OF THE INVENTION

Provided herein is a polypeptide having ketol-acid reductoisomerase activity, wherein the amino acid at the position corresponding to 52 of SEQ ID NO: 2 is D or E, and wherein the polypeptide comprises at least one substitution in one of the following regions: in at least one of the inter-molecular dimer interface region, inter-domain interface region, N-domain surface helix region, hydrophobic bridge region, or the C-terminal tail region, wherein the at least one substitution is at the position corresponding to I13, V53, A68, A69, A71, G72, V76, S86, L88, K99, Y113, N114, V117, I127, I152, S157, V171, M238, Y239, E264, N267, A268, Q272, R275, A277, R280, Y286, I291, S292, A295, M301, R306, S322, A329, K335, or A336 of SEQ ID NO: 2. In embodiments, the polypeptide further comprises a substitution at at least one of position L33, P47, F50, F61, I80, or V156. In embodiments, the polypeptide comprises at least about 80%, at least about 85%, at least about 90%, at least about 95%, at least about 99% identity to SEQ ID NO: 2

Provided herein are polypeptide variants comprising at least about 80% identity, at least about 85%, at least about 90%, at least about 95%, or at least about 99% identity to SEQ ID NO: 1 or SEQ ID NO: 2 and a substitution at at least one of the following positions: Y286, I152, S322, S292, I291, I13, P47, F50, V53, A268, V76, A336, L88, A71, G72, M301, Y239, Y113, N114, A329, A69, A295, E264, R280, S157, M238, Q272, K335, K99, R275, or R306. In embodiments, the polypeptides have ketol-acid reductoisomerase activity.

Accordingly, provided herein are polypeptides comprising (a) the amino acid sequence of SEQ ID NO: 3, 4, 5, 6, 7, 8, 9, 10, 11, 12, 13, 14, 15, 16, 17, 18, 20, 22, 23, 24, 25, 26, 27, 28, 29, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 74, 75, 76, 77, 78, 79, 80, 81, 82, 83, 84, 85, 86, 87, 88, 89, 90, 91, 92, 93, 94, 95, 96, 97, 99, 100, 101, 102, 103, 104, 105, 106, 107, 108, 109, 110, 111, 112, 113, 114, 116, 118, 119, 120, 121, 123, 124, 128, 129, 131, 132, 133, 134, 136, 137, 138, 139, 140, 141, 142, 143, 144, 146, 147, 148, 149, 150, 151, 152, 153, 154, 155, 157, 159, 160, 161, 346, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, or 382; (b) at least about 95% or at least about 99% identity to SEQ ID NO: 3, 4, 5, 6, 7, 8, 9, 10, 11, 12, 13, 14, 15, 16, 17, 18, 20, 22, 23, 24, 25, 26, 27, 28, 29, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 74, 75, 76, 77, 78, 79, 80, 81, 82, 83, 84, 85, 86, 87, 88, 89, 90, 91, 92, 93, 94, 95, 96, 97, 99, 100, 101, 102, 103, 104, 105, 106, 107, 108, 109, 110, 111, 112, 113, 114, 116, 118, 119, 120, 121, 123, 124, 128, 129, 131, 132, 133, 134, 136, 137, 138, 139, 140, 141, 142, 143, 144, 146, 147, 148, 149, 150, 151, 152, 153, 154, 155, 157, 159, 160, 161, 346, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, or 382; or (c) an active fragment of (a) or (b). In some embodiments, microbial host cells comprise such polypeptides. In some embodiments, such microbial host cells produce isobutanol.

Polypeptides provided herein include polypeptides having ketol-acid reductoisomerase activity and comprising at least about 85%, at least about 95%, or at least about 99% identity to SEQ ID NO: 2 and at least one of the following substitutions: Y286F, A336R, I152V, S322A, S292A, I291V, or a combination thereof; or an active fragment of such polypeptide. In embodiments, the polypeptides further comprise at least one of the following substitutions: I13L, P47Y, F50A, V53A, A268E, V76I, A336G, L88V, or a combination thereof. In embodiments, polypeptides comprise 95% or at least about 99% identity to SEQ ID NO: 3, 4, 5, 6, 7, 8, 9, 10, 11, 12, 13, 14, 15, 16, 17, 18, 20, 22, 23, 24, 25, 26, 27, 28, or 29.

Polypeptides provided herein include polypeptides having ketol-acid reductoisomerase activity and comprising at least about 85%, at least about 95%, or at least about 99% identity to SEQ ID NO: 2 and at least one of the following substitutions: Y286F, A71K, G72W, A336R, I152V, A268T, A329E, or a combination thereof; or an active fragment of such polypeptide. In embodiments, polypeptides comprise at least about 95% or at least about 99% identity to SEQ ID NO: 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, or 64.

Polypeptides provided herein include polypeptides having ketol-acid reductoisomerase activity and comprising at least about 85%, at least about 95%, or at least about 99% identity to SEQ ID NO: 41: and at least one of the following substitutions M301I, Y239H, Y113F, S322A, A71K, N114G, A329R, A69T, N114S, G72W, A295V, E264K, R280D, A329E, S157T, M238I, Q272T, K335M, R280H, or a combination thereof; or an active fragment of such polypeptide. In embodiments, polypeptides comprise at least about 95% or at least about 99% identity to SEQ ID NO: 99, 100, 101, 102, 103, 104, 105, 106, 107, 108, 109, 110, 111, 112, 113, 114, 116, 118, 119, 120, 121, 123, 124, 128, 129, 131, 132, 133, 134, 136, 137, 138, 139, 140, 141, 142, 143, 144, 146, 147, 148, 149, 150, 151, 152, 153, 154, 155, 157, 159, 160, or 161. In embodiments, the polypeptide having ketol-acid reductoisomerase activity comprises the amino acid sequence of SEQ ID NO: 365, 366, 159, 152, 377, 367, 123, 42, or 41.

Polypeptides provided herein include polypeptides having ketol-acid reductoisomerase activity and comprising at least about 85%, at least about 95%, or at least about 99% identity to SEQ ID NO: 346 and at least one of the following substitutions: A68E, I152V, Y286F, and A336R.

The polypeptides provided here also may increase biosynthetic pathway productivity as compared to SEQ ID NO:2 or wild type ketol-acid reductoisomerase enzymes. The increase in productivity may include an increase in performance of a step of the pathway such as rate of the reaction catalyzed by the ketol-acid reductoisomerase and/or reduced susceptibility to inhibition or substrate competition. The increase in productivity may also manifest in an increase in product yield such as increased isobutanol production as compared to polypeptides without the modifications described herein such as SEQ ID NO: 2. The productivity increase may be on the order of at least about 1%, 2%, 3%, 4%, 5%, 6%, 7%, 8%, 9%, 10%, 15%, 20%, 25%, 30%, 35%, 40%, 45%, 50% to about 100%.

In embodiments, in polypeptides provided herein, the amino acid at the position corresponding to position 52 of SEQ ID NO: 2 is D or E. In embodiments, the amino acid at the position corresponding to position 24 of SEQ ID NO: 2 is F; the amino acid at the position corresponding to position 33 of SEQ ID NO: 2 is L; the amino acid at the position corresponding to position 47 of SEQ ID NO: 2 is P; the amino acid at the position corresponding to position 50 of SEQ ID NO: 2 is F; the amino acid at the position corresponding to position 61 of SEQ ID NO: 2 is F; the amino acid at the position corresponding to position 80 of SEQ ID NO: 2 is I; and the amino acid at the position corresponding to position 156 of SEQ ID NO: 2 is V.

Also provided herein are polynucleotides encoding such polypeptides. Also provided are recombinant microbial host cell comprising such polynucleotides. Also provided herein are recombinant microbial host cells comprising such polypeptides. In some embodiments, microbial host cells further comprise reduced or eliminated acetolactate reductase activity. In embodiments, host cells further comprises at least one deletion, mutation, and/or substitution in fra2. In embodiments, host cells further comprise the substrate to product conversions: pyruvate to acetolactate; acetolactate to 2,3-dihydroxyisovalerate; 2,3-dihydroxyisovalerate to α-ketoisovalerate; α-ketoisovalerate to isobutyraldehyde; and isobutyraldehyde to isobutanol. In embodiments, the polypeptide having ketol-acid reductoisomerase activity is selected from the group consisting of SEQ ID Nos: 11, 41, and 42. In embodiments, the polypeptide having ketol-acid reductoisomerase activity comprises the amino acid sequence of SEQ ID NO: 365, 366, 159, 152, 377, 367, 123, 42, or 41. In embodiments, the host cell is a yeast host cell. In embodiments, the host cell is *Saccharomyces cerevisiae*.

Also provided herein are methods for converting acetolactate to dihydroxyisovalerate comprising the polypeptides provided. Also provided are methods for converting acetolactate to dihydroxyisovalerate comprising providing a microbial host cell comprising a polypeptide provided; and contacting the polypeptide with acetolactate wherein dihydroxyisovalerate is produced. Also provided are methods of producing a product selected from the group consisting of isobutanol, pantothenate, valine, leucine, isoleucine, 3,3-dimethylmalate, and 2-methyl-1-butanol comprising: providing a recombinant host cell provided herein wherein the recombinant host cell comprises a product biosynthetic pathway; and contacting the microbial host cell with a carbon substrate under conditions whereby the product is produced. In embodiments, at least a portion of the contacting occurs under anaerobic conditions.

BRIEF DESCRIPTION OF THE DRAWINGS

In FIG. 10A, the location of positions M238, Y239, E264, N267, A268, Q272, A277, R280, Y286, I291, S292, M301, S322, in the intermolecular dimer interface is shown. In FIG. 10B, the location of positions Y113, N114, N114, I291, S292, and A295, in the inter-domain interface region are shown.

DETAILED DESCRIPTION

Figure 1:
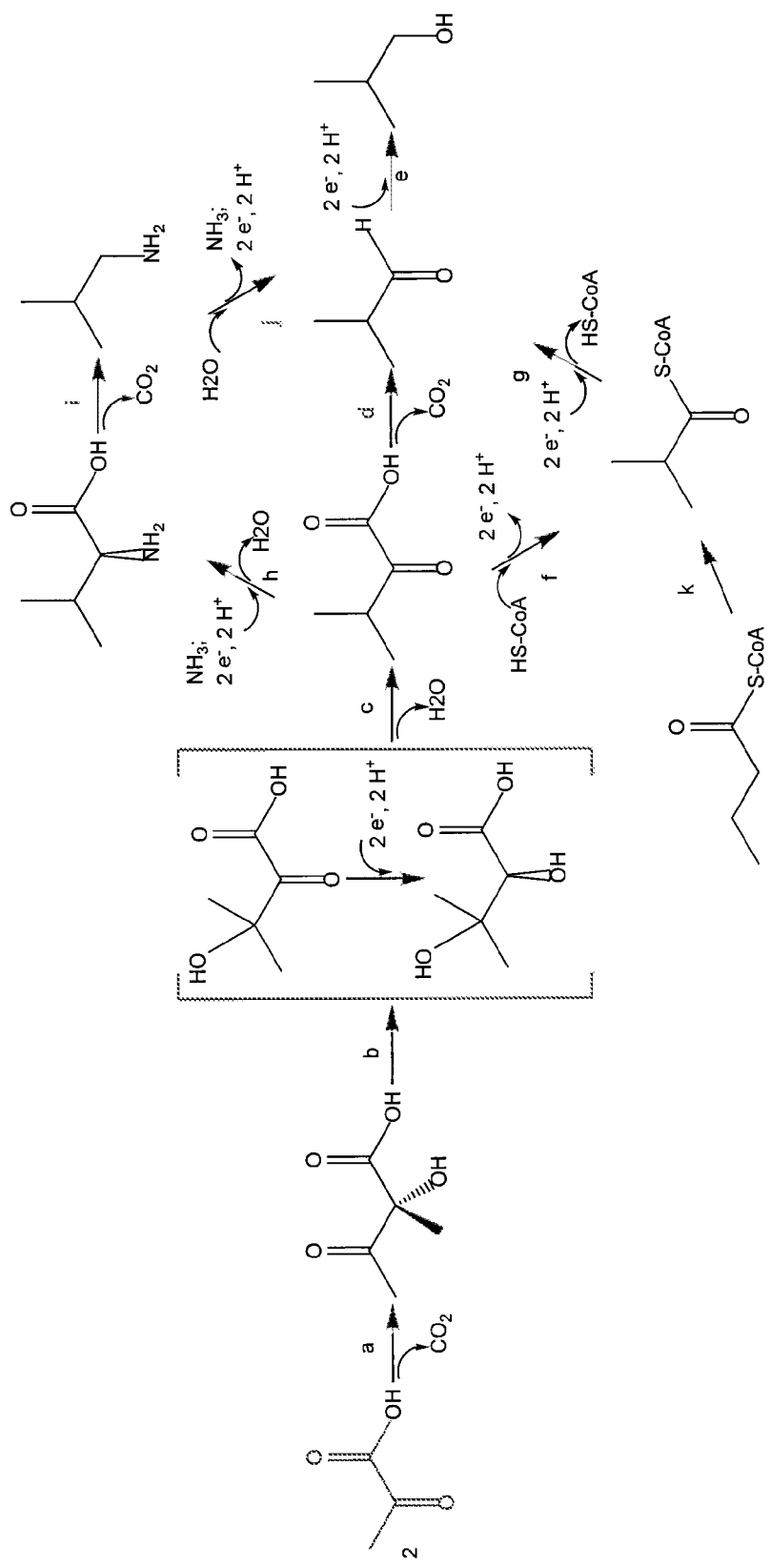
FIG. 1-Shows four different isobutanol biosynthetic pathways. The steps labeled "a", "b", "c", "d", "e", "f", "g", "h", "i", "j" and "k" represent the substrate to product conversions described below.
Figure 2:
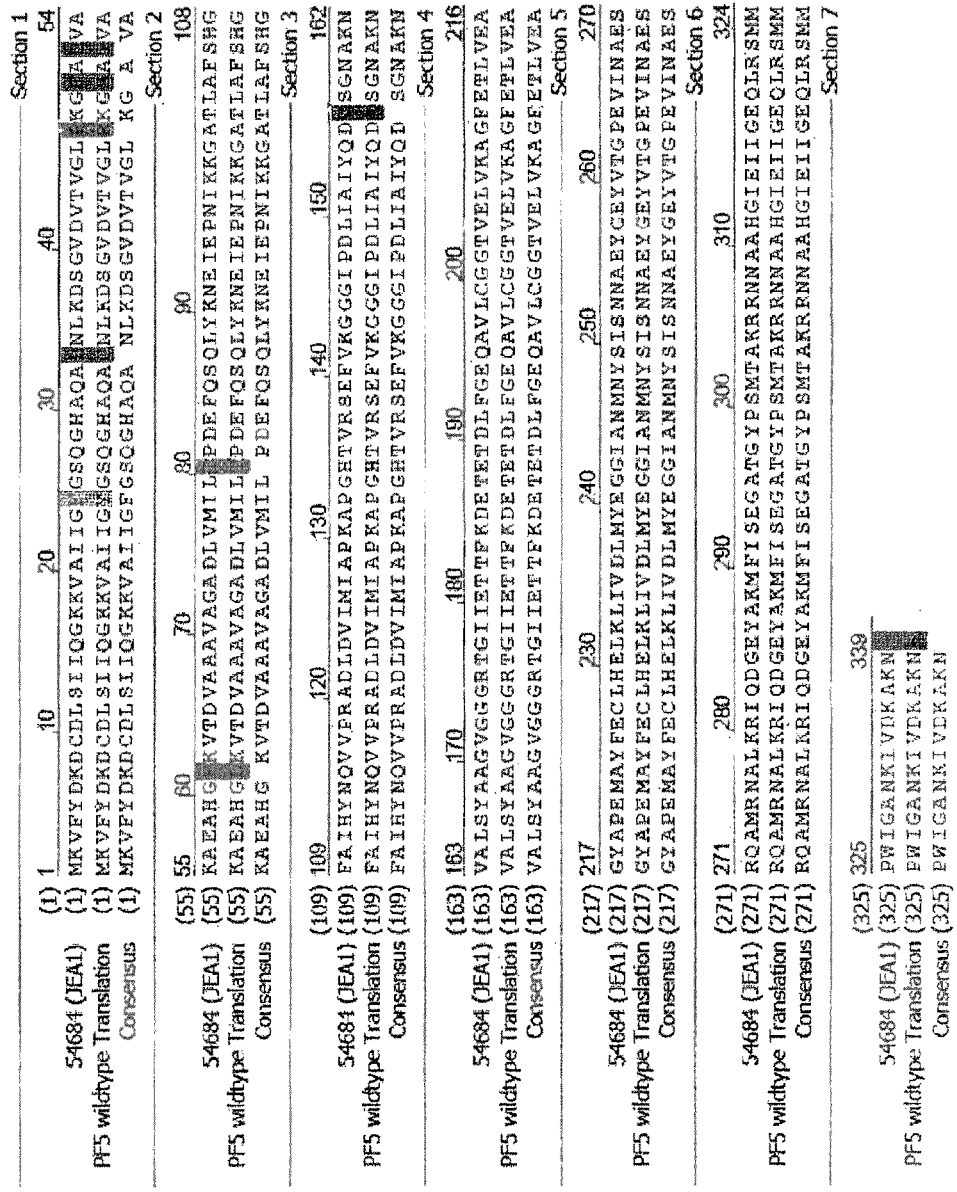
FIG. 2 depicts an alignment of the amino acid sequences of the KARI from *Pseudomonas fluorescens* ("PF5"; SEQ ID NO: 1) and a variant thereof ("JEA1"; SEQ ID NO: 2; described in U.S. Appn. Pub. No. 2010/0197519 which is incorporated herein by reference).

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference, unless only specific sections of patents or patent publications are indicated to be incorporated by reference.

Although methods and materials similar or equivalent to those disclosed herein can be used in practice or testing of the present invention, suitable methods and materials are disclosed below. The materials, methods and examples are illustrative only and are not intended to be limiting. Other features and advantages of the invention will be apparent from the detailed description and from the claims.

In order to further define this invention, the following terms, abbreviations and definitions are provided.

It will be understood that "derived from" with reference to polypeptides disclosed herein encompasses sequences synthesized based on the amino acid sequences of the KARIs present in the indicated organisms as well as those cloned directly from the organism's genetic material.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. §2111.03.

Also, the indefinite articles "a" and "an" preceding an element or component of the invention are intended to be nonrestrictive regarding the number of instances, i.e., occurrences of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the claims as presented or as later amended and supplemented, or in the specification.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, or within 5% of the reported numerical value.

The term "isobutanol biosynthetic pathway" refers to the enzymatic pathway to produce isobutanol. For example, certain isobutanol biosynthetic pathways are disclosed in U.S. Pat. No. 7,851,188, which is incorporated by reference in its entirety herein. Certain isobutanol biosynthetic pathways are illustrated in FIG. 1 and described herein. From time to time "isobutanol biosynthetic pathway" is used synonymously with "isobutanol production pathway".

The term "butanol" as used herein refers to 2-butanol, 1-butanol, isobutanol or mixtures thereof. Isobutanol is also known as 2-methyl-1-propanol.

A recombinant host cell comprising an "engineered alcohol production pathway" (such as an engineered butanol or isobutanol production pathway) refers to a host cell containing a modified pathway that produces alcohol in a manner different than that normally present in the host cell. Such differences include production of an alcohol not typically produced by the host cell, or increased or more efficient production.

The term "heterologous biosynthetic pathway" as used herein refers to an enzyme pathway to produce a product in which at least one of the enzymes is not endogenous to the host cell containing the biosynthetic pathway.

The term "extractant" as used herein refers to one or more solvents which can be used to extract butanol from a fermentation broth.

The term "effective titer" as used herein, refers to the total amount of a particular alcohol (e.g. butanol) produced by fermentation per liter of fermentation medium. The total amount of butanol includes: (i) the amount of butanol in the fermentation medium; (ii) the amount of butanol recovered from the organic extractant; and (iii) the amount of butanol recovered from the gas phase, if gas stripping is used.

The term "effective rate" as used herein, refers to the total amount of butanol produced by fermentation per liter of fermentation medium per hour of fermentation.

The term "effective yield" as used herein, refers to the amount of butanol produced per unit of fermentable carbon substrate consumed by the biocatalyst.

The term "separation" as used herein is synonymous with "recovery" and refers to removing a chemical compound from an initial mixture to obtain the compound in greater purity or at a higher concentration than the purity or concentration of the compound in the initial mixture.

The term "aqueous phase," as used herein, refers to the aqueous phase of a biphasic mixture obtained by contacting a fermentation broth with a water-immiscible organic extractant. In an embodiment of a process described herein that includes fermentative extraction, the term "fermentation broth" then specifically refers to the aqueous phase in biphasic fermentative extraction.

The term "organic phase," as used herein, refers to the non-aqueous phase of a biphasic mixture obtained by contacting a fermentation broth with a water-immiscible organic extractant.

The terms "PDC-," "PDC knockout," or "PDC-KO" as used herein refer to a cell that has a genetic modification to inactivate or reduce expression of a gene encoding pyruvate decarboxylase (PDC) so that the cell substantially or completely lacks pyruvate decarboxylase enzyme activity. If the cell has more than one expressed (active) PDC gene, then each of the active PDC genes can be inactivated or have minimal expression thereby producing a PDC-cell.

The term "polynucleotide" is intended to encompass a singular nucleic acid as well as plural nucleic acids, and refers to a nucleic acid molecule or construct, e.g., messenger RNA (mRNA) or plasmid DNA (pDNA). A polynucleotide can contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. "Polynucleotide" embraces chemically, enzymatically, or metabolically modified forms.

A polynucleotide sequence can be referred to as "isolated," in which it has been removed from its native environment. For example, a heterologous polynucleotide encoding a polypeptide or polypeptide fragment having dihydroxy-acid dehydratase activity contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA can be comprised of one or more segments of cDNA, genomic DNA or synthetic DNA.

The term "NAD(P)H consumption assay" refers to an enzyme assay for the determination of the specific activity of the KARI enzyme, involving measuring the disappearance of the KARI cofactor, NAD(P)H, from the enzyme reaction. Such assays are described in Aulabaugh and Schloss, Biochemistry 29: 2824-2830, 1990, which is herein incorporated by reference in its entirety.

The term "NAD(P)H" refers to either NADH or NADPH.

"KARI" is the abbreviation for the enzyme ketol-acid reductoisomerase.

The term "close proximity" when referring to the position of various amino acid residues of a KARI enzyme with respect to the adenosyl 2'-phosphate of NADPH means amino acids in the three-dimensional model for the structure of the enzyme that are within about 4.5 Å of the phosphorus atom of the adenosyl 2'-phosphate at NADPH bound to the enzyme.

The term "ketol-acid reductoisomerase" (abbreviated "KARI"), and "acetohydroxy acid isomeroreductase" will be used interchangeably and refer to enzymes capable of catalyzing the reaction of (S)-acetolactate to 2,3-dihydroxyisovalerate, classified as EC number EC 1.1.1.86 (Enzyme Nomenclature 1992, Academic Press, San Diego). KARI is found in a variety of organisms and amino acid sequence comparisons across species have revealed that there are 2 types of this enzyme: a short form (class I) found in fungi and most bacteria, and a long form (class II) typical of plants. Class I KARIs typically have between 330-340 amino acid residues. The long form KARI enzymes have about 490 amino acid residues. However, some bacteria such as

*Escherichia coli* possess a long form, where the amino acid sequence differs appreciably from that found in plants. KARI is encoded by the ilvC gene and is an essential enzyme for growth of *E. coli* and other bacteria in a minimal medium. Class II KARIs generally consist of a 225-residue N-terminal domain and a 287-residue C-terminal domain. The N-terminal domain, which contains the cofactor-binding site, has an αβstructure and resembles domains found in other pyridine nucleotide-dependent oxidoreductases. The C-terminal domain consists almost entirely of α-helices.

KARI enzymes are described for example, in U.S. Pat. Nos. 7,910,342 and 8,129,162 and U.S. Pub, App, No. 2010/0197519, all of which are herein incorporated by reference in their entireties.

Ketol-acid reductoisomerase (KARI) enzymes are useful in pathways for the production of isobutanol using engineered microorganisms (U.S. Pat. Nos. 7,851,188 and 7,993,889, incorporated by reference in their entireties herein).

A KARI that can utilize NADH can capitalize on the NADH produced by the existing glycolytic and other metabolic pathways in most commonly used microbial cells and can result in improved isobutanol production. Rane et al. (Arch. Biochem. Biophys., 338: 83-89, 1997) discusses cofactor switching of a ketol acid reductoisomerase isolated from *E. coli*. US Appl. Pub. Nos. 2009/0163376 and 2010/0197519 (each of which is herein incorporated by reference it its entirety) describe variants of KARI enzymes which can use NADH. US Appl. Pub. No. 201010143997 (which is herein incorporated by reference in its entirety) describes *E. coli* variants with improved $K_M$ values for NADH.

The terms "ketol-acid reductoisomerase activity" and "KARI activity" refer to the ability to catalyze the substrate to product conversion (S)-acetolactate to 2,3-dihydroxyisovalerate.

The term "acetolactate synthase" refers to an enzyme that is catalyzes the conversion of pyruvate to acetolactate and $CO_2$.

Acetolactate has two stereoisomers ((R) and (S)); the enzyme prefers the (S)-isomer, which is made by biological systems. Certain acetolactate synthases are known by the EC number 2.2.1.6 (Enzyme Nomenclature 1992, Academic Press, San Diego). These enzymes are available from a number of sources, including, but not limited to, *Bacillus subtilis* (SEQ ID NO: 165), *Klebsiella pneumoniae* (SEQ ID NO: 166) and *Lactococcus lactis*.

The term "acetohydroxy acid dehydratase" refers to an enzyme that catalyzes the conversion of 2,3-dihydroxyisovalerate to α-ketoisovalerate. Certain acetohydroxy acid dehydratases are known by the EC number 4.2.1.9. These enzymes are available from a vast array of microorganisms, including, but not limited to, *E. coli, S. cerevisiae, M. maripaludis, B. subtilis, Lactococcus lactis* (SEQ ID NO:167), and *Streptococcus mutans* (SEQ ID NO: 168).

The term "branched-chain α-keto acid decarboxylase" refers to an enzyme that catalyzes the conversion of α-ketoisovalerate to isobutyraldehyde and $CO_2$. Certain branched-chain α-keto acid decarboxylases are known by the EC number 4.1.1.72 and are available from a number of sources, including, but not limited to, *Lactococcus lactis* (SEQ ID NO: 169), *Salmonella typhimurium, Clostridium acetobutylicum, Macrococcus caseolyticus* (SEQ ID NO: 171), and *Listeria grayi* (SEQ ID NO: 170).

The term "branched-chain alcohol dehydrogenase" refers to an enzyme that catalyzes the conversion of isobutyraldehyde to isobutanol. Certain branched-chain alcohol dehydrogenases are known by the EC number 1.1.1.265, but can also be classified under other alcohol dehydrogenases (specifically, EC 1.1.1.1 or 1.1.1.2). These enzymes utilize NADH (reduced nicotinamide adenine dinucleotide) and/or NADPH as electron donor and are available from a number of sources, including, but not limited to, *S. cerevisiae, E. coli, C. acetobutylicum, B. indica* (SEQ ID NO: 173), *A. xylosoxidans* (SEQ ID NO: 172).

As used herein, "DHMB" refers to 2,3-dihydroxy-2-methyl butyrate. DHMB includes "fast DHMB," which has the 2S, 3S configuration, and "slow DHMB," which has the 2S, 3R configurate. See Kaneko et al., Phytochemistry 39: 115-120 (1995), which is herein incorporated by reference in its entirety and refers to fast DHMB as angliceric acid and slow DHMB as tigliceric acid.

As used herein, "reduced activity" refers to any measurable decrease in a known biological activity of a polypeptide when compared to the same biological activity of the polypeptide prior to the change resulting in the reduced activity. Such a change can include a modification of a polypeptide or a polynucleotide encoding a polypeptide as described herein. A reduced activity of a polypeptide disclosed herein can be determined by methods well known in the art and/or disclosed herein.

As used herein, "eliminated activity" refers to the complete abolishment of a known biological activity of a polypeptide when compared to the same biological activity of the polypeptide prior to the change resulting in the eliminated activity. Such a change can include a modification of a polypeptide or a polynucleotide encoding a polypeptide as described herein. An eliminated activity includes a biological activity of a polypeptide that is not measurable when compared to the same biological activity of the polypeptide prior to the change resulting in the eliminated activity. An eliminated activity of a polypeptide disclosed herein can be determined by methods well known in the art and/or disclosed herein.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof. Non-limiting examples of carbon substrates are provided herein and include, but are not limited to, monosaccharides, oligosaccharides, polysaccharides, ethanol, lactate, succinate, glycerol, carbon dioxide, methanol, glucose, fructose, sucrose, xylose, arabinose, dextrose, or mixtures thereof. Other carbon substrates can include ethanol, lactate, succinate, or glycerol.

"Fermentation broth" as used herein means the mixture of water, sugars (fermentable carbon sources), dissolved solids (if present), microorganisms producing alcohol, product alcohol and all other constituents of the material held in the fermentation vessel in which product alcohol is being made by the reaction of sugars to alcohol, water and carbon dioxide ($CO_2$) by the microorganisms present. From time to time, as used herein the term "fermentation medium" and "fermented mixture" can be used synonymously with "fermentation broth".

"Biomass" as used herein refers to a natural product containing a hydrolysable starch that provides a fermentable sugar, including any cellulosic or lignocellulosic material and materials comprising cellulose, and optionally further comprising hemicellulose, lignin, starch, oligosaccharides, disaccharides, and/or monosaccharides. Biomass can also comprise additional components, such as protein and/or lipids. Biomass can be derived from a single source, or biomass can comprise a mixture derived from more than one source. For example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood, and forestry waste. Examples of biomass include, but are not limited to, corn grain, corn cobs, crop residues such as corn husks, corn stover, grasses, wheat, rye, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

"Feedstock" as used herein means a product containing a fermentable carbon source. Suitable feedstock include, but are not limited to, rye, wheat, corn, sugar cane, and mixtures thereof.

The term "aerobic conditions" as used herein means growth conditions in the presence of oxygen. Typically, oxygen is replaced by agitation of the medium such that gas exchange with the atmosphere occurs.

The term "microaerobic conditions" as used herein means growth conditions with low levels of oxygen (i.e., below normal atmospheric oxygen levels). "Microaerobic conditions" include conditions wherein the medium is not necessarily oxygen free when innoculated with a microorganism, but, the oxygen present in the medium is consumed and its replacement by gas exchange is limited, for example, by limiting agitation and/or sealing the vessel from the atmosphere.

The term "anaerobic conditions" as used herein means growth conditions in the absence of oxygen.

The term "isolated nucleic acid molecule", "isolated nucleic acid fragment" and "genetic construct" will be used interchangeably and will mean a polymer of RNA or DNA that is single- or double-stranded, optionally containing synthetic, non-natural or altered nucleotide bases. An isolated nucleic acid fragment in the form of a polymer of DNA can be comprised of one or more segments of cDNA, genomic DNA or synthetic DNA.

The term "amino acid" refers to the basic chemical structural unit of a protein or polypeptide. The following abbreviations are used herein to identify specific amino acids:

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Cysteine | Cys | C |
| Glutamine | Gln | Q |
| Glutamic acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene can comprise regulatory sequences and coding sequences to that are derived from different sources, or regulatory sequences and coding sequences derived from the same source, but arranged in a manner different than that found in nature. "Endogenous gene" refers to a native gene in its natural location in the genome of a microorganism. A "foreign" gene refers to a gene not normally found in the host microorganism, but that is introduced into the host microorganism by gene transfer. Foreign genes can comprise native genes inserted into a non-native microorganism, or chimeric genes. A "transgene" is a gene that has been introduced into the genome by a transformation procedure.

As used herein, "native" refers to the form of a polynucleotide, gene, or polypeptide as found in nature with its own regulatory sequences, if present.

As used herein the term "coding sequence" or "coding region" refers to a DNA sequence that encodes for a specific amino acid in sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, is translation leader sequences, introns, polyadenylation recognition sequences, RNA processing sites, effector binding sites and stem-loop structures.

As used herein, "endogenous" refers to the native form of a polynucleotide, gene or polypeptide in its natural location in the organism or in the genome of an organism. "Endogenous polynucleotide" includes a native polynucleotide in its natural location in the genome of an organism. "Endogenous gene" includes a native gene in its natural location in the genome of an organism. "Endogenous polypeptide" includes a native polypeptide in its natural location in the organism transcribed and translated from a native polynucleotide or gene in its natural location in the genome of an organism.

The term "heterologous" when used in reference to a polynucleotide, a gene, or a polypeptide refers to a polynucleotide, gene, or polypeptide not normally found in the host organism. "Heterologous" also includes a native coding region, or portion thereof, that is reintroduced into the source organism in a form that is different from the corresponding native gene, e.g., not in its natural location in the organism's genome. The heterologous polynucleotide or gene can be introduced into the host organism by, e.g., gene transfer. A heterologous gene can include a native coding region with non-native regulatory regions that is reintroduced into the native host. For example, a heterologous gene can include a native coding region that is a portion of a chimeric gene including non-native regulatory regions that is reintroduced into the native host. "Heterologous polypeptide" includes a native polypeptide that is reintroduced into the source organism in a form that is different from the corresponding native polypeptide.

A "transgene" is a gene that has been introduced into the genome by a transformation procedure.

As used herein, the term "modification" refers to a change in a polynucleotide disclosed herein that results in reduced or eliminated activity of a polypeptide encoded by the polynucleotide, as well as a change in a polypeptide disclosed herein that results in reduced or eliminated activity of the polypeptide. Such changes can be made by methods well known in the art, including, but not limited to, deleting, mutating (e.g., spontaneous mutagenesis, random mutagenesis, mutagenesis caused by mutator genes, or transposon mutagenesis), substituting, inserting, down-regulating, altering the cellular location, altering the state of the polynucleotide or polypeptide (e.g., methylation, phosphorylation or ubiquitination), removing a cofactor, introduction of an antisense RNA/DNA, introduction of an interfering RNA/DNA, chemical modification, covalent modification, irradiation with UV or X-rays, homologous recombination, mitotic recombination, promoter replacement methods, and/or combinations thereof. Guidance in determining which nucleotides or amino acid residues can be modified, can be found by comparing the sequence of the particular polynucleotide or polypeptide with that of homologous polynucleotides or polypeptides, e.g., yeast or bacterial, and maximizing the number of modifications made in regions of high homology (conserved regions) or consensus sequences.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, enhancers, operators, repressors, transcription termination signals, translation leader sequences, introns, polyadenylation recognition sequences, RNA processing site, effector binding site and stem-loop structure.

The term "promoter" refers to a nucleic acid sequence capable of controlling the expression of a coding sequence or functional RNA. In general, a coding sequence is located 3' to a promoter sequence, Promoters can be derived in their entirety from a native gene, or be composed of different elements derived from different promoters found in nature, or even comprise synthetic nucleic acid segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters". "Inducible promoters," on the other hand, cause a gene to be expressed when the promoter is induced or turned on by a promoter-specific signal or molecule. It is further recognized that since in most cases the exact boundaries of regulatory sequences have not been completely defined, DNA fragments of different lengths can have identical promoter activity. For example, it will be understood that "FBA1 promoter" can be used to refer to a fragment derived from the promoter region of the FBA1 gene.

The term "terminator" as used herein refers to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence. It is recognized that since in most cases the exact boundaries of regulatory sequences have not been completely defined, DNA fragments of different lengths can have identical terminator activity. For example, it will be understood that "CYC1 terminator" can be used to refer to a fragment derived from the terminator region of the CYC1 gene.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression can also refer to translation of mRNA into a polypeptide.

The term "overexpression," as used herein, refers to expression that is higher than endogenous expression of the same or related gene. A heterologous gene is overexpressed if its expression is higher than that of a comparable endogenous gene. The term overexpression refers to an increase in the level of nucleic acid or protein in a host cell. Thus, overexpression can result from increasing the level of transcription or translation of an endogenous sequence in a host cell or can result from the introduction of a heterologous sequence into a host cell. Overexpression can also result from increasing the stability of a nucleic acid or protein sequence.

As used herein the term "transformation" refers to the transfer of a nucleic acid fragment into the genome of a host microorganism, resulting in genetically stable inheritance. Host microorganisms containing the transformed nucleic acid fragments are referred to as "transgenic" or "recombinant" or "transformed" microorganisms.

The terms "plasmid", "vector" and "cassette" refer to an extra chromosomal element often carrying genes which are not part of the central metabolism of the cell, and usually in the form of circular double-stranded DNA fragments. Such elements can be autonomously replicating sequences, genome integrating sequences, phage or nucleotide sequences, linear or circular, of a single- or double-stranded DNA or RNA, derive from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

As used herein the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F) | TCT Ser (S) | TAT Tyr (Y) | TGT Cys (C) |
|   | TTC Phe (F) | TCC Ser (S) | TAC Tyr (Y) | TGC Cys (C) |
|   | TTA Leu (L) | TCA Ser (S) | TAA Stop    | TGA Stop |
|   | TTG Leu (L) | TCG Ser (S) | TAG Stop    | TGG Trp (W) |
| C | CTT Leu (L) | CCT Pro (P) | CAT His (H) | CGT Arg (R) |
|   | CTC Leu (L) | CCC Pro (P) | CAC His (H) | CGC Arg (R) |
|   | CTA Leu (L) | CCA Pro (P) | CAA Gln (Q) | CGA Arg (R) |
|   | CTG Leu (L) | CCG Pro (P) | CAG Gln (Q) | CGG Arg (R) |
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met (M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code m for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at www.kazusa.or.jp/codon/ (visited Mar. 20, 2008), and these tables can be adapted in a number of ways. See Nakamura, Y., et al, Nucl. Acids Res. 28:292 (2000). Codon usage tables for yeast, calculated from GenBank Release 128.0 [15 Feb. 2002], are reproduced below as Table 2B. This table uses mRNA nomenclature, and so instead of thymine (T) which is found in DNA, the tables use uracil (U) which is found in RNA. Table 2 has been adapted so that frequencies are calculated for each amino acid, rather than for all 64 codons.

TABLE 2

Codon Usage Table for *Saccharomyces cerevisiae*

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |

TABLE 2-continued

Codon Usage Table for *Saccharomyces cerevisiae*

| Amino Acid | Codon | Number | Frequency per thousand |
|---|---|---|---|
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |

TABLE 2-continued

Codon Usage Table for *Saccharomyces cerevisiae*

| Amino Acid | Codon | Number | Frequency per thousand |
|---|---|---|---|
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function at www.entelechon.com/bioinformatics/backtranslation.php?lang=eng (visited Apr. 15, 2008) and the "backtranseq" function available at http://bioinfo.pbi.nrc.ca:8090/EMBOSS/index.html (visited Jul. 9, 2002). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (userpages.umbc.edu/~wug1/codon/sgd/, visited Mar. 19, 2012).

A polynucleotide or nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. Molecular Cloning: A Laboratory Manual, 2nd ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post hybridization washes determine stringency conditions. One set of conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. Another set of stringent conditions uses higher temperatures in which the washes are identical to those above except for the temperature of the final two 30 min washes in 0.2× SSC, 0.5% SDS was increased to 60° C. Another set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50 9.51). For hybridizations with shorter nucleic acids, i.e., oligonucleotides, the position of mismatches becomes more important, and the length of the oligonucleotide determines its specificity (see Sambrook et al., supra, 11.7 11.8). In one embodiment the length for a hybridizable nucleic acid is at least about 10 nucleotides. In one embodiment, a minimum length for a hybridizable nucleic acid is at least about 15 nucleotides; at least about 20 nucleotides; or the length is at least about 30 nucleotides. Furthermore, the skilled artisan will recognize that the temperature and wash solution salt concentration can be adjusted as necessary according to factors such as length of the probe.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein", "amino acid chain," or any other term used to refer to a chain or chains of two or more amino acids, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis. Suitable methods for polypeptide synthesis are known in the art.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the terms "variant" and "mutant" are synonymous and refer to a polypeptide differing from a specifically recited polypeptide by one or more amino acid insertions, deletions, mutations, and substitutions, created using, e.g., recombinant DNA techniques, such as mutagenesis. Guidance in determining which amino acid residues can be replaced, added, or deleted without abolishing activities of interest, can be found by comparing the sequence of the particular polypeptide with that of homologous polypeptides, e.g., yeast or bacterial, and minimizing the number of amino acid sequence changes made in regions of high homology (conserved regions) or by replacing amino acids with consensus sequences.

"Engineered polypeptide" as used herein refers to a polypeptide that is synthetic, i.e., differing in some manner from a polypeptide found in nature.

Alternatively, recombinant polynucleotide variants encoding these same or similar polypeptides can be synthesized or selected by making use of the "redundancy" in the genetic code. Various codon substitutions, such as silent changes which produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide. For example, mutations can be used to reduce or eliminate expression of a target protein and include, but are not limited to, deletion of the entire gene or a portion of the gene, inserting a DNA fragment into the gene (in either the promoter or coding region) so that the protein is not expressed or expressed at lower levels, introducing a mutation into the coding region which adds a stop codon or frame shift such that a functional protein is not expressed, and introducing one or more mutations into the coding region to alter amino acids so that a non-functional or a less enzymatically active protein is expressed.

Amino acid "substitutions" can be the result of replacing one amino acid with another amino acid having similar structural and/or chemical properties, i.e., conservative amino acid replacements, or they can be the result of replacing one amino acid with an amino acid having different structural and/or chemical properties, i.e., non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., J. Mol. Biol., 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides can be used in sequence-dependent methods of gene identification (e.g., Southern hybridization) and isolation (e.g., in situ hybridization of bacterial colonies or bacteriophage plaques). In addition, short oligonucleotides of 12-15 bases can be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, can now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenine is complementary to thymine and cytosine is complementary to guanine, and with respect to RNA, adenine is complementary to uracil and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) Computational Molecular Biology (Lesk, A. M., Ed.) Oxford University: NY (1988); 2.) Biocomputing: Informatics and Genome Projects (Smith, D. W., Ed.) Academic: NY (1993); 3.) Computer Analysis of Sequence Data, Part I (Griffin, A. M., and Griffin, H. G., Eds.) Humania: NJ (1994); 4.) Sequence Analysis in Molecular Biology (von Heinje, G., Ed.) Academic (1987); and 5.) Sequence Analysis Primer (Gribskov, M. and Devereux, J., Eds.) Stockton: NY (1991).

Methods to determine identity are designed to give the best match between the sequences tested. Methods to determine identity and similarity are codified in publicly available computer programs. Sequence alignments and percent identity calculations can be performed using the MegAlign™ program of the LASERGENE bioinformatics computing suite (DNASTAR Inc., Madison, Wis.). Multiple alignments of the sequences are performed using the "Clustal method of alignment" which encompasses several varieties of the algorithm including the "Clustal V method of alignment" corresponding to the alignment method labeled Clustal V (described by Higgins and Sharp, CABIOS. 5:151-153 (1989); Higgins, D. G. et al., Comput. Appl. Biosci., 8:189-191 (1992)) and found in the MegAlignn™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Ciustal V program, it is possible to obtain a "percent identity" by viewing the "sequence distances" table in the same program. Additionally the "Ciustal W method of alignment" is available and corresponds to the alignment method labeled Clustal W (described by Higgins and Sharp, CABIOS. 5:151-153 (1989); Higgins, D. G. et al., Comput. Appl. Biosci. 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides wherein such polypeptides have the same or similar function or activity, or in describing the corresponding polynucleotides. Useful examples of percent identities include, but are not limited to: 55%, 60%, 65%, 70%, 75%, 80%, 85%, 90%, or 95%, or any integer percentage from 55% to 100% can be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable polynucleotide fragments not only have the above homologies but typically comprise a polynucleotide having at least 50 nucleotides, at least 100 nucleotides, at least 150 nucleotides, at least 200 nucleotides, or at least 250 nucleotides. Further, suitable polynucleotide fragments having the above homologies encode a polypeptide having at least 50 amino acids, at least 100 amino acids, at least 150 amino acids, to at least 200 amino acids, or at least 250 amino acids. Polynucleotides can be cloned or synthesized using methods known in the art.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., J. Mol. Biol., 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques are well known in the art and are described by Sambrook, J., Fritsch, E. F. and Maniatis, T., Molecular Cloning: A Laboratory Manual, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., Experiments with Gene Fusions, Cold Spring Harbor Laboratory Press, Cold Spring Harbor, N.Y. (1984); and by Ausubel, F. M. et al., Current Protocols in Molecular Biology, published by Greene Publishing Assoc. and Wiley-Interscience (1987). Additional methods used here are in Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.). Other molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 January 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al. (2006) Yeast; 23(5):399-405), and gap repair methodology (Ma et al., Genetics 58:201-216; 1981).

The genetic manipulations of a recombinant host cell disclosed herein can be performed using standard genetic techniques and screening and can be made in any host cell that is suitable to genetic manipulation (Methods in Yeast Genetics, 2005, Cold Spring Harbor Laboratory Press, Cold Spring Harbor, N.Y., pp. 201-202).

In embodiments, a recombinant host cell disclosed herein can be any yeast or fungi host useful for genetic modification and recombinant gene expression including those yeast mentioned elsewhere herein. In other embodiments, a recombinant host cell can be a member of the genera *Issatchenkia, Zygosaccharomyces, Saccharomyces, Schizosaccharomyces, Dekkera, Torulopsis, Brettanomyces, Torulaspora, Hanseniaspora, Kluveromyces, Yarrowia*, and some species of *Candida*.

Polypeptides with KARI Activity Suited for Biosynthetic Pathways

US Appl. Pub. No. 2010/0197519A1 describes variants of the *Pseudomonas fluorescens* KARI enzyme suitable for isobutanol production, including a variant "JEA1" (SEQ ID NO: 2) which was demonstrated to have a lower $K_M$ for the cofactor NADH than the wild-type enzyme.

As demonstrated in the Examples herein, variants of JEA1 have been provided which are believed to be particularly suitable for use in recombinant microbial host cells comprising an isobutanol biosynthetic pathway, including yeast cells such as *S. cerevisiae* and in methods utilizing such host cells under anaerobic conditions. As such, the variants provided herein may also be useful in other biosynthetic pathways comprising a substrate to product conversion catalyzed by KARI activity.

Based on the results given in the Examples, substitutions at one or more, two or more, three or more, four or more, five or more, six or more, seven or more, or eight or more of the following positions of SEQ ID NO: 2 give rise to polypeptides suited for use in recombinant host cells comprising an isobutanol biosynthetic pathway: Y286, I152, S322, S292, I291, I13, P47, F50, V53, A268, V76, A336, L88, A71, G72, M301, Y239, Y113, N114, A329, A69, A295, E264, R280, S157, M238, Q272, K335, K99, R275, R306.

In embodiments, substitutions at these positions include, but are not limited to, those demonstrated in the Examples: Y286F, A336R, I152V, S322A, S292A, I291V, I13L, P47Y, F50A, V53A, A268E, V76I, A336G, L88V, A71K, G72W, I152V, A268T, A329E, M301I, Y239H, Y113F, S322A, N114G, A329R, A69T, N114S, A295V, E264K, R280D, S157T, M238I, Q272T, K335M, R280H, K99N, R275K, R306K or a combination thereof.

Combinations of substitutions may include, but are not limited to, those demonstrated in Examples 1-5, Tables 9, 11, 13, 15, and 17. As demonstrated, certain of the combinations of substitutions are suitable for use in recombinant microbial host cells comprising an isobutanol biosynthetic pathway.

For example, as shown in Example 2, a suitable combination is Y286, A336, and I152. Example variants with substitutions in these positions are demonstrated in the Examples. In embodiments, the substitutions at these positions are Y286F, A336R, and I152V. Another suitable combination is A68, I152, Y286 and A336. In embodiments, the substitutions at these positions are A68E, I152V, Y286F, and A336R. An example variant containing those substitutions is given as SEQ ID NO: 346 ("R8-SOG1_y2").

Other combinations comprise substitutions at one or more of the following sites: A69, A71, Y113, M238, Y239, M301, A322, or A329. Examples of such combinations are shown in Example 5.

In embodiments, for variants provided herein, including variants in comprising substitutions at I152, Y286 and A336 and optionally A68 substitutions may be selected from those indicated with an "X" in Table 3 for the indicated positions:

TABLE 3

| Substitutions for KARI variants | | | |
|---|---|---|---|
| Amino Acid | Position 152 | Position 286 | Position 336 |
| A, Ala | X | X | X |
| C, Cys | X | X | X |
| D, Asp | X | — | X |
| E, Glu | X | — | X |
| F, Phe | X | X | X |
| G, Gly | X | — | X |
| H, His | X | X | X |
| I, Ile | X | X | X |
| K, Lys | X | — | X |
| L, Leu | X | — | X |
| M, Met | X | X | X |
| N, Asn | X | — | X |
| P, Pro | X | — | X |
| Q, Gln | X | — | X |
| R, Arg | X | — | X |
| S, Ser | X | — | X |
| T, Thr | X | — | X |
| V, Val | X | — | X |

TABLE 3-continued

| Substitutions for KARI variants | | | |
|---|---|---|---|
| Amino Acid | Position 152 | Position 286 | Position 336 |
| W, Trp | X | X | X |
| Y, Tyr | X | X | X |

Equipped with this disclosure, one of skill in the art can readily make and use additional substitutions at any of the indicated sites (Y286, I152, S322, S292, I291, I13, P47, F50, V53, A268, V76, A336, L88, A71, G72, M301, Y239, Y113, N114, A329, A69, A295, E264, R280, S157, M238, Q272, K335, K99, R275, and R306.) to produce additional variants. Methods of generating such variants are demonstrated herein (see Example 6) and/or are known in the art as described below. In one embodiment, conservative substitutions are made based on the sequences exemplified herein. In another embodiment, all or a subset of amino acids are substituted at a given site and screened for activity.

In embodiments, in polypeptides provided herein: the amino acid at the position corresponding to position 24 of SEQ ID NO: 2 is F; the amino acid at the position corresponding to position 33 of SEQ ID NO: 2 is L; the amino acid at the position corresponding to position 47 of SEQ ID NO: 2 is P; the amino acid at the position corresponding to position 50 of SEQ ID NO: 2 is F; the amino acid at the position corresponding to position 61 of to SEQ ID NO: 2 is F; the amino acid at the position corresponding to position 80 of SEQ ID NO: 2 is I; and the amino acid at the position corresponding to position 156 of SEQ ID NO: 2 is V.

It will be appreciated that using a combination of structural and sequence information available in the art, polypeptides comprising KARI activity and less than 100% identity to the exemplified sequences can be constructed for use in isobutanol or other biosynthetic pathways. For example, crystal structures of the *E. coli* KARI enzyme at 2.6 Å resolution have been solved (Tyagi, et al., Protein Sci., 14: 3089-3100, 2005) as has the structure of the *P. aeruginosa* KARI (Ahn, et al., J. Mol. Biol., 328: 505-515, 2003) and the KARI enzyme from spinach (Biou V., et al. The EMBO Journal, 16: 3405-3415, 1997). Furthermore, a KARI Profile HMM prepared using amino acid sequences of 25 KARI proteins with experimentally verified function is described in U.S. Pat. No. 8,129, 162. The KARIs were from *Pseudomonas fluorescens* Pf-5, *Sulfolobus solfataricus* P2, *Pyrobaculum aerophilum* str. 1M2, *Natronomonas pharaonis* DSM 2160, *Bacillus subtilis* subsp. *subtilis* str. 168, *Corynebacterium glutamicum* ATCC 13032, *Phaeospririlum molischianurn*, *Ralstonia solanacearum* GMI1000, *Zymomonas mobilis* subsp. *mobilis* ZM4, *Alkalilimnicola ehrhichei* MLHE-, *Campylobacter lari* RM2100, *Marinobacter aquaeolei* VT8, *Psychrobacter arcticus* 273-4, *Hahella chejuensis* KCTC 2396, *Thiobacillus denitrificans* ATCC 25259, *Azotobacter vinelandii* AvOP, *Pseudomonas syringae* pv. syringae B728a, *Pseudomonas syringae* pv. tomato str. DC3000, *Pseudomonas putida* KT2440, *Pseudomonas entomophila* L48, *Pseudomonas mendocina* ymp, *Pseudomonas aeruginosa* PAO1, *Bacillus cereus* ATCC 10987, *Bacillus cereus* ATCC 10987, and *Spinacia oleracea*. Any protein that matches the KARI Profile HMM (described in U.S. Pat. No. 8,129,162 and incorporated by reference in its entirety herein) with an E value of <$10^{-3}$ using hmmsearch program in the HMMER package is expected to be a functional KARI.

As shown in FIGS. 9-12, substitution positions disclosed herein can be grouped according to their structural location using homology modeling of PF5 KARI as disclosed in U.S. Pat. No. 8,129,162. As disclosed therein, the structure of PF5-KARI with bound NADPH, acetolactate and magnesium ions was built based on the crystal structure of *P. aeruginosa* PAO1-KARI (PDB ID 1NP3, Ahn H. J. et al, J. Mol. Biol., 328, 505-515, 2003) which has 92% amino acid sequence identity to PF5 KARI. PAO1-KARI structure is a homo-dodecamer and each dodecamer consists of six homo-dimers with extensive dimer interface. The active site of KARI is located in this dimer interface. The biological assembly is formed by six homo-dimers positioned on the edges of a tetrahedron resulting in a highly symmetrical dodecamer of 23 point group symmetry. For simplicity, only the dimeric unit (monomer A and monomer B) was built for the homology model of PF5-KARI because the active site is in the homo-dimer interface.

The model of PF5-KARI dimer was built based on the coordinates of monomer A and monomer B of PAO1-KARI and sequence of PF5-KARI using DeepView/Swiss PDB viewer (Guex, N. and Peitsch, M. C. Electrophoresis 18: 2714-2723, 1997). This model was then imported to program O (Jones, T. A. et al, Acta Crystallogr. A 47, 110-119, 1991) on a Silicon Graphics system for further modification.

The structure of PAO1-KARI has no cofactor, substrate or inhibitor or magnesium in the active site. Therefore, the spinach KARI structure (PDB ID 1yve, Biou V. et al. The EMBO Journal, 16: 3405-3415, 1997.), which has magnesium ions, NADPH and inhibitor (N-Hydroxy-N-isopropyloxamate) in the acetolactate binding site, was used to model these molecules in the active site. The plant KARI has very little sequence identity to either PF5- or PAO1 KARI (<20% amino acid identity), however the structures in the active site region of these two KARI enzymes are very similar. To overlay the active site of these two KARI structures, commands LSQ_ext, LSQ_improve, LSQ_mol in the program O were used to line up the active site of monomer A of spinach KARI to the monomer A of PF5 KARI model. The coordinates of NADPH, two magnesium ions and the inhibitor bound in the active site of spinach KARI were extracted and incorporated to molecule A of PF5 KARI. A set of the coordinates of these molecules was generated for monomer B of PF5 KARI by applying the transformation operator from monomer A to monomer B calculated by the program.

Because there is no cofactor in the active site of PAO1 KARI crystal structure, the structures of the phosphate binding loop region in the cofactor binding site (residues 44-45 in PAO1 KARI, 157-170 in spinach KARI) are very different between the two. To model the cofactor-bound form, the model of the PF5-KARI phosphate binding loop (44-55) was replaced by that of 1yve (157-170). Any discrepancy of side chains between these two was converted to those in the PF5-KARI sequence using the mutate_replace command in program O, and the conformations of the replaced side-chains were manually adjusted. The entire NADPH/Mg/inhibitor bound dimeric PF5-KARI model went through one round of energy minimization using program CNX (ACCELRYS San Diego Calif., Burnger, A. T. and Warren, G. L., Acta Crystallogr., D 54, 905-921, 1998) after which the inhibitor was replaced by the substrate, acetolactate (AL), in the model. The conformation of AL was manually adjusted to favor hydride transfer between C4 of the nicotinamide of NADPH and the substrate. No further energy minimization was performed on this model.

The C-terminal tail (328-338) is not seen in the model and is disordered in the crystal structure PDB code 1np3 that was used to build the homology model of Pf5-KARI. The C-terminal tail has been shown to be important for the binding of cofactor and substrate during catalysis (JMB (2009)389, 167-182 Leung & Guddat).The following positions are in the C-terminal tail region: A329, K335, A336.

Figure 10A:
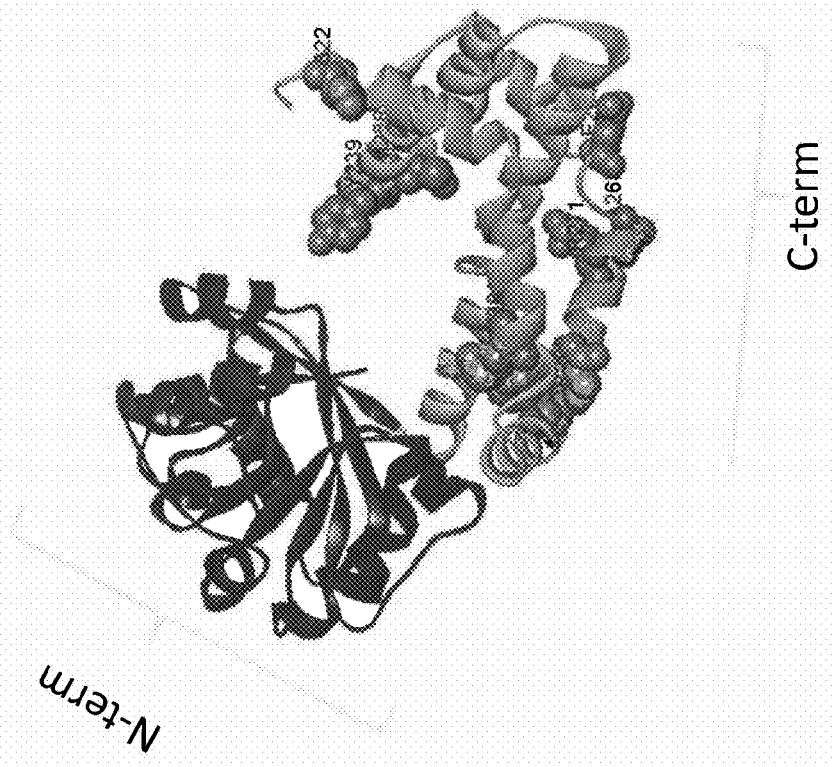
FIGS. 10A and 10B show the homology model of Pf5 KARI, monomer A only. The N-domain (residues 1-181) and the C-domain (residues 182-327) are shown.
Figure 10B:
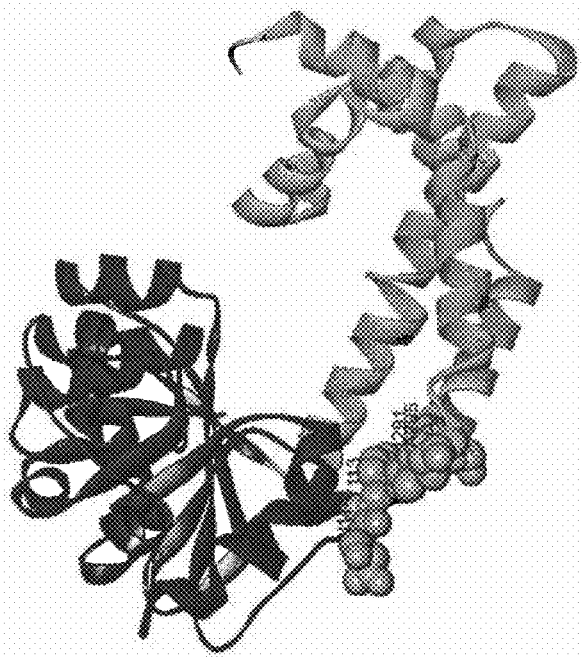

As shown in FIG. 10, positions M238, Y239, E264, N267, A268, Q272, A277, R280, Y286, I291, S292, M301, S322, are associated with the inter-molecular dimer interface region, and positions Y113, N114, I291, S292, and A295 are associated with the inter-domain interface region.

Figure 11A:
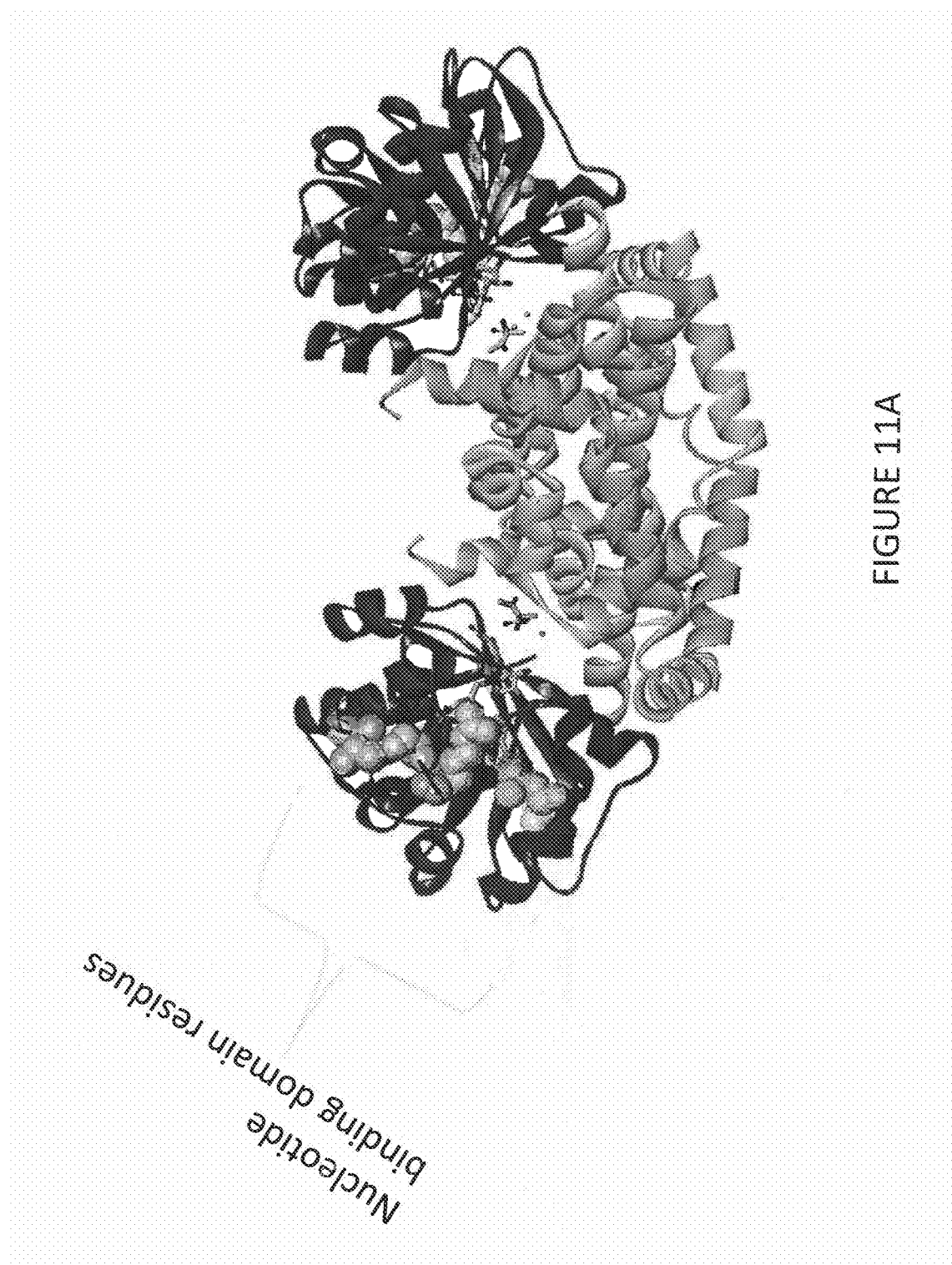
FIG. 11A shows the positions of P47, P50, V53, T80, and L88, part of the modeled nucleotide binding region.
Figure 11B:
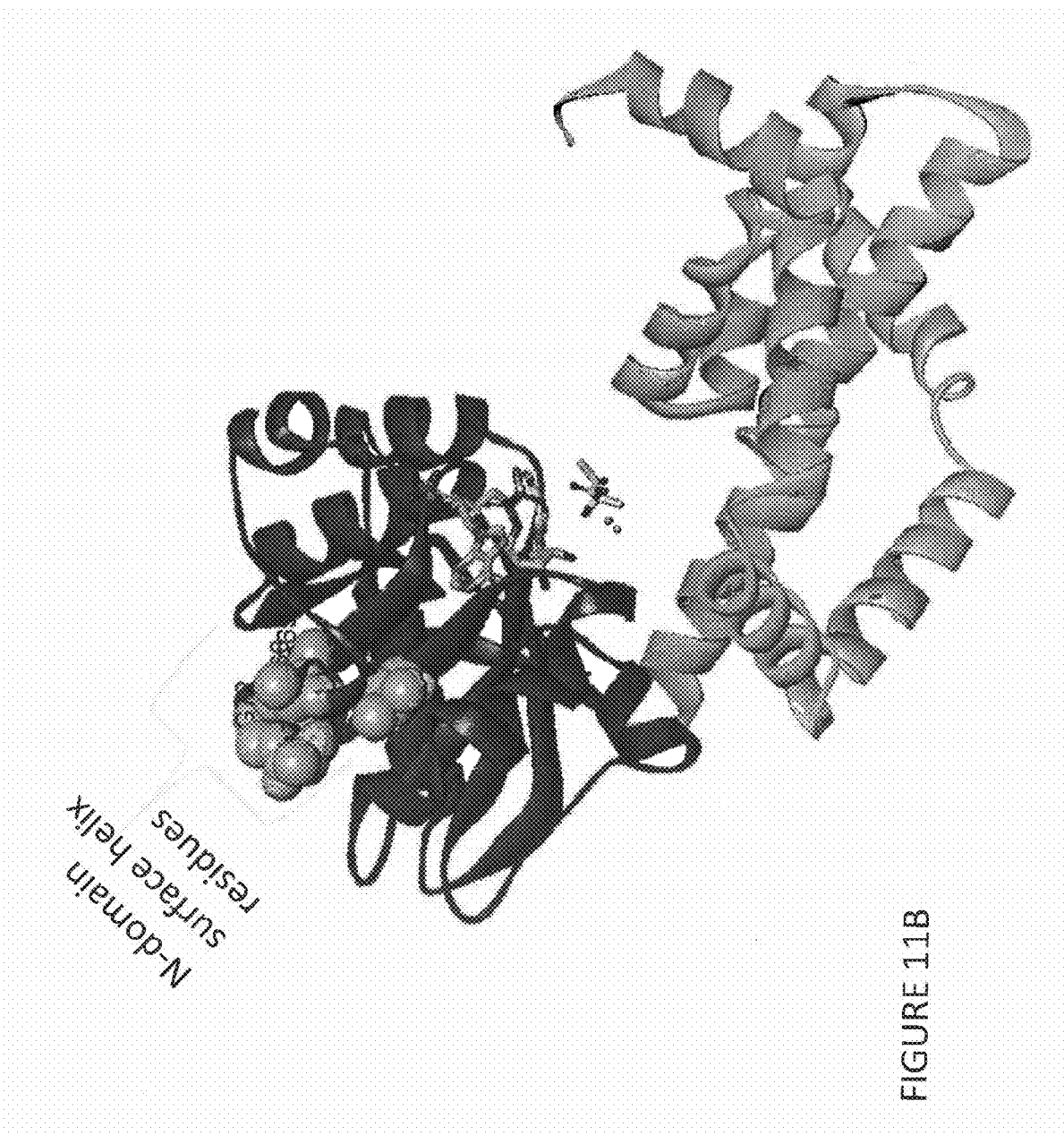
FIG. 11B shows positions 68, 69, 71 and 72 on an alpha helix of two short turns (positions 64-73) on the surface of the N-domain. Residue 76 in the model interacts with the side chain of residue 70 through hydrophobic interaction. The N-terminal portion of this short helix is packed against the main chain of residue 47 part of the modeled nucleotide binding region.

Positions of P47, P50, V53, T80, and L88 are part of the modeled nucleotide binding region (FIG. 11A), Positions 68, 69, 71 and 72 are associated with N-domain surface helix (positions 64-73; FIG. 11B).

Figure 12:
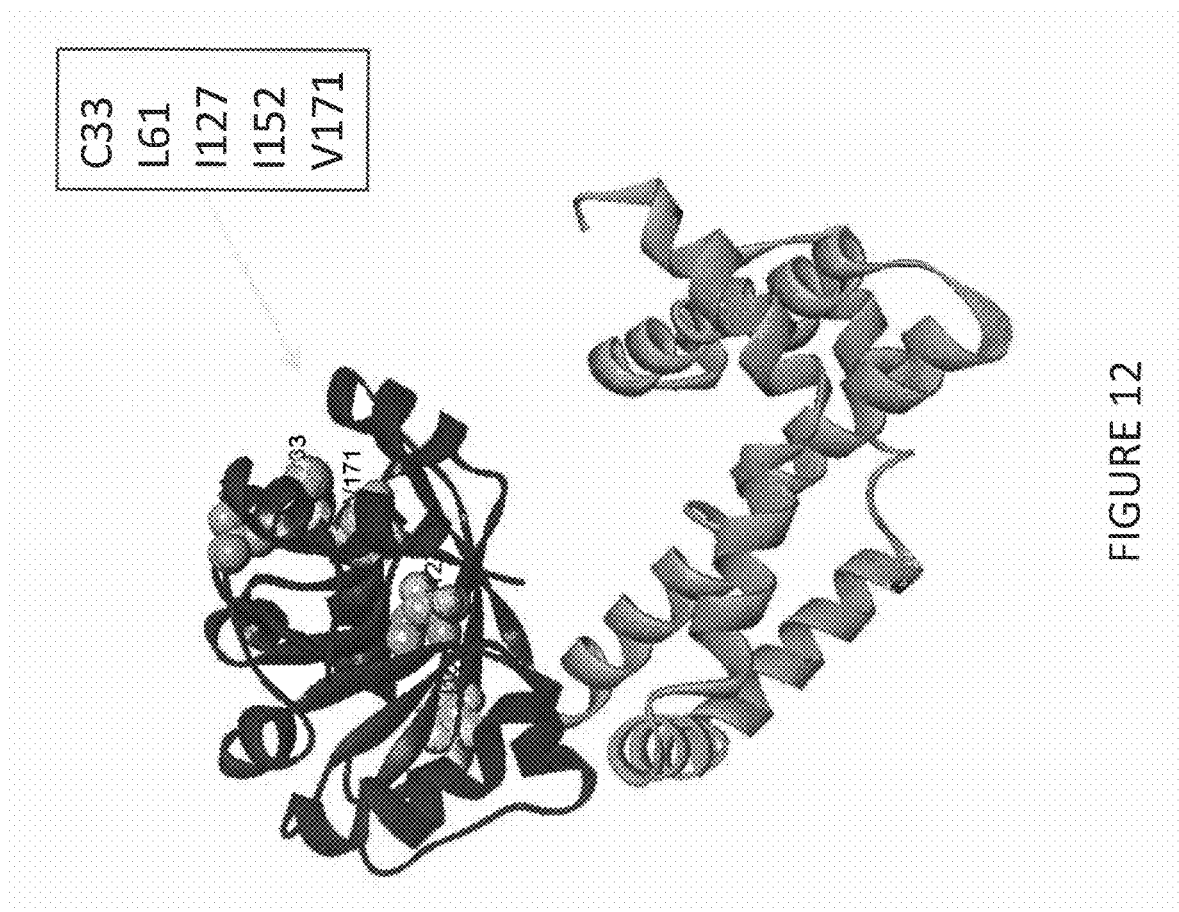
FIG. 12 shows the positions C33, L61, I127, I152, and V171 in the N-domain hydrophobic bridge region.

Positions C33, L61, I127, I152, and V171 are in the N-domain hydrophobic bridge region, shown in FIG. 12.

Accordingly, provided herein are variants comprising substitutions in at least one of the inter-molecular dimer interface region, inter-domain interface region, nucleotide binding region, N-domain surface helix region, hydrophobic bridge region, and the C-terminal tail region. In embodiments, variants provided herein comprise substitutions in the nucleotide binding region and substitutions in at least one of, at least two of, or at least three of the following regions: the inter-molecular dimer interface region, inter-domain interface region, N-domain surface helix region, hydrophobic bridge region, or the C-terminal tail region.

The sequences of other polynucleotides, genes and/or polypeptides can be identified in the literature and in bioinformatics databases well known to the skilled person using sequences disclosed herein and available in the art. For example, such sequences can be identified through BLAST searching of publicly available databases with polynucleotide or polypeptide sequences provided herein. In such a method, identities can be based on the Clustal W method of alignment using the default parameters of GAP PENALTY=10, GAP LENGTH PENALTY=0.1, and Gonnet 250 series of protein weight matrix.

Additionally, polynucleotide or polypeptide sequences disclosed herein can be used to identify other KARI homologs in nature. For example, each of the KARI encoding nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor et al., Proc. Acad. Sci. USA 82:1074 (1985); or strand displacement amplification (SDA), Walker et al., Proc. Natl. Acad. Sci. U.S.A., 89:392 (1992)]; and (3) methods of library construction and screening by complementation.

It will be appreciated that one of ordinary skill in the art, equipped with this disclosure as well as sequence and structural information available herein and/or in the art, can also generate active fragments of to polypeptides provided herein, for example, by truncating polypeptides provided herein at the N-terminus or C-terminus and confirming KARI activity.

Accordingly, provided herein are polypeptides having at least about 90% identity to, at least about 95% identity to, at least about 99% identity to, or having the amino acid sequence of SEQ ID NO: 3, 4, 5, 6, 7, 8, 9, 10, 11, 12, 13, 14, 15, 16, 17, 18, 20, 22, 23, 24, 25, 26, 27, 28, 29, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 99, 100, 101, 102, 103, 104, 105, 106, 107, 108, 109, 110, 111, 112, 113, 114, 116, 118, 119, 120, 121, 123, 124, 128, 129, 131, 132, 133, 134, 136, 137, 138, 139, 140, 141, 142, 143, 144, 146, 147, 148, 149, 150, 151, 152, 153, 154, 155, 157, 159, 160, 161, or 346 or an active fragment thereof.

Generation of Variants

Variants described herein may be generated by any method known in the art. Methods known in the art for site-directed mutagenesis include, for example, QuikChange® (Agilent, Santa Clara, Calif.) and Change-IT® (Affymetrix/USB, Santa Clara, Calif.). Methods known in the art for random point mutagenesis include, for example, error-prone PCR (e.g., Bloom et al., BMC Biol. 2007, 5:29, doi:10.1186/1741-7007-5-29.) or GeneMorph®(Agilent, Santa Clara, Calif.), exposure to chemical mutagens (e.g., ethyl methanesulfonate) or ultraviolet light, use of modified nucleotides in PCR (e.g., Wong et al., Nucleic Acids Res. 2004, 32:3, e26.), and use of special mutator strains. Methods known in the art for DNA recombination or "shuffling" include, for example, random fragmentation and reassembly (e.g. Stemmer 1994 Proc. Natl. Acad. Sci. USA 91:22, 10747-10751.), heteroduplex repair (e.g., Volkov et al., Nucleic Acids Res. 1999 27:18, e18.), staggered extension (e.g., Zhao et al., Nat. Biotechnol. 1998, 16:3, 258-261.), unpaired-primer shuffling (e.g., Milano et al., U.S. Pat. No. 7,879,582), site-directed recombination (e.g., Hiraga et al., J. Mol. Biol. 2003, 330:2, 287-296.), and synthetic shuffling (e.g., Ness et al., Nat. Biotechnol. 2002, 20, 1251-1255.). Other methods for protein variant library construction include, for example, circular permutation (e.g., Guntas et al., PLoS One, 2012, 7(4):e35998), and chemical DNA synthesis.

Equipped with this disclosure, one of skill in the art can readily make and use the variants provided herein as well as variants with less than 100% identity (as described above) thereto.

KARI Activity

Polypeptides described herein include those with KARI activity. KARI activity can be confirmed by assaying for the enzymatic conversion of acetolactate to 2,3-dihydroxyisovalerate using methods described in the art (for example in U.S. Pat. No. 8,129,162, incorporated herein by reference). For example, the conversion may be followed by measuring the disappearance of the cofactor, NADPH or NADH, from the reaction at 340 nm using a plate reader (such as from Molecular Device, Sunnyvale, Calif.).

KARI activity may also be confirmed by expressing a given KARI in a host cell comprising polynucleotides encoding polypeptides that catalyze the substrate to product conversions given in FIG. 1, steps a, c, d, and e and measuring the production of isobutanol, as described and demonstrated herein (see Examples). Alternatively, KARI activity may be confirmed by measuring the production of intermediate products in the biosynthetic pathway downstream of the substrate to product conversion catalyzed by KARI. Likewise, host cells comprising the substrate to product conversions for other biosynthetic pathways can also be used to confirm KARI activity using a like strategy and confirming the production of the biosynthetic pathway product or intermediate products downstream of the substrate to product conversion catalyzed by KARI.

Confirmation of Isobutanol Production

The presence and/or concentration of isobutanol in the culture medium can be determined by a number of methods known in the art (see, for example, U.S. Pat. No. 7,851,188, incorporated by reference in its entirety). For example, a specific high performance liquid chromatography (HPLC) method utilizes a Shodex SH-1011 column with a Shodex SHG guard column, both may be purchased from Waters Corporation (Milford, Mass.), with refractive index (RI) detection. Chromatographic separation is achieved using 0.01 M $H_2SO_4$ as the mobile phase with a flow rate of 0.5 mL/min and a column temperature of 50° C. Isobutanol has a retention time of 46.6 min under the conditions used.

Alternatively, gas chromatography (GC) methods are available. For example, a specific GC method utilizes an HP-INNOWax column (30 m×0.53 mm id, 1 µm film thickness, Agilent Technologies, Wilmington, Del.), with a flame ionization detector (FID). The carrier gas is helium at a flow rate of 4.5 mL/min, measured at 150° C. with constant head pressure; injector split is 1:25 at 200° C.; oven temperature is 45° C. for 1 min, 45 to 220° C. at 10° C./min, and 220° C. for 5 min; and FID detection is employed at 240° C. with 26 mL/min helium makeup gas. The retention time of isobutanol is 4.5 min.

Reduction of DHMB

The production of DHMB in a host cell comprising an isobutanol biosynthetic pathway indicates that not all of the pathway substrates are being converted to the desired product. Thus, yield is lowered. In addition, DHMB can have inhibitory effects on product production. For example, DHMB can decrease the activity of enzymes in the biosynthetic pathway or have other inhibitory effects on yeast growth and/or productivity during fermentation. Thus, the methods described herein provide ways of reducing DHMB during fermentation. The methods include both methods of decreasing the production of DHMB and methods of removing DHMB from fermenting compositions.

Decreasing DHMB Production

In some embodiments described herein, a recombinant host cell can comprise reduced or eliminated ability to convert acetolactate to DHMB. The ability of a host cell to convert acetolactate to DHMB can be reduced or eliminated, for example, by a modification or disruption of a polynucleotide or gene encoding a polypeptide having acetolactate reductase activity or a modification or disruption of a polypeptide having acetolactate reductase activity. In other embodiments, the recombinant host cell can comprise a deletion, mutation, and/or substitution in an endogenous polynucleotide or gene encoding a polypeptide having acetolactate reductase activity or in an endogenous polypeptide having acetolactate reductase. Such modifications, disruptions, deletions, mutations, and/or substitutions can result in acetolactate reductase activity that is reduced, substantially eliminated, or eliminated. In some embodiments of the invention, the product of the biosynthetic pathway is produced at a greater yield or amount compared to the production of the same product in a recombinant host cell that does not comprise reduced or eliminated ability to convert acetolactate to DHMB.

Thus, the product can be a composition comprising isobutanol that is substantially free of, or free of DHMB. In some embodiments, the composition comprising butanol contains no more than about 5 mM, about 4 mM, about 3 mM, about 2 mM, about 1 mM, about 0.5 mM, about 0.4 mM, about 0.3 mM DHMB, or about 0.2 mM DHMB.

Any product of a biosynthetic pathway that involves the conversion of acetolactate to a substrate other than DHMB can be produced with greater effectiveness in a recombinant host cell disclosed herein having the described modification of acetolactate reductase activity. Such products include, but are not limited to, butanol, e.g., isobutanol, 2-butanol, and BDO, and branched chain amino acids.

In some embodiments, the host cell comprises at least one deletion, mutation, and/or substitution in at least one endogenous polynucleotide encoding a polypeptide having acetolactate reductase activity. In some embodiments, the host cell comprises at least one deletion, mutation, and/or substitution in each of at least two endogenous polynucleotides encoding polypeptides having acetolactate reductase activity.

In some embodiments, a polypeptide having acetolactate reductase activity can catalyze the conversion of acetolactate to DHMB. In some embodiments, a polypeptide having acetolactate reductase activity is capable of catalyzing the reduction of acetolactate to 2S,3S-DHMB (fast DHMB) and/or 2S,3R-DHMB (slow DHMB).

TABLE 4

Polypeptides and polynucleotides having acetolactate reductase activity in Saccharomyces cerevisiae

| Gene | SEQ ID NO: (nucleic acid, amino acid) |
|---|---|
| YMR226C | 174, 175 |
| YIL074C (Chr 9) | 176, 177 |
| YIR036C (Chr 9) | 178, 179 |
| YPL061W (ALD6)(Chr 16) | 180, 181 |
| YPL088W(Chr 16) | 182, 183 |
| YCR105W (ADH7)(Chr 3) | 184, 185 |
| YDR541C(Chr 4) | 186, 187 |
| YER081 (SER3)(Chr 5) | 188, 189 |
| YPL275W (FDH2)(Chr 16) | 190, 191 |
| YBR006W (UGA5)(Chr2) | 192, 193 |
| YOL059W (Chr 15) | 194, 195 |

TABLE 4-continued

Polypeptides and polynucleotides having acetolactate reductase activity in Saccharomyces cerevisiae

| Gene | SEQ ID NO: (nucleic acid, amino acid) |
|---|---|
| YER081W (Chr 5) | 196, 197 |
| YOR375C (Chr 15) | 198, 199 |

In some embodiments, the conversion of acetolactate to DHMB in a recombinant host cell is reduced, substantially eliminated, or eliminated.

In some embodiments, the polypeptide having acetolactate reductase activity is selected from the group consisting of: YMR226C, YER081W, YIL074C, YBR006W, YPL275W, YOL059W, YIR036C, YPL061W, YPL088W, YCR105W, YOR375C, and YDR541C. In some embodiments, the polypeptide having acetolactate reductase activity is a polypeptide comprising a sequence listed in Table 4 or a sequence that is at least about 70%, at least about 75%, at least about 80%, at least about 85%, at least about 90%, at least about 95%, or at least about 99% identical to a polypeptide sequence listed in Table 4. In some embodiments, the polypeptide having acetolactate reducatase activity is a polypeptide encoded by a polynucleotide sequence listed in Table 4 or a sequence that is at least about 70%, at least about 75%, at least about 80%, at least about 85%, at least about 90%, at least about 95%, or at least about 99% identical to a polynucleotide sequence listed in Table 4.

TABLE 5

Example YMR226C Yeast Homologs

| Species | Accession # | SEQ ID NO: (nucleic acid, amino acid) |
|---|---|---|
| Saccharomyces paradoxus | AABY01000127 | 200, 201 |
| Saccharomyces bayanus | AACA01000631 | 202, 203 MSQGRKAAERLANKTVLITGAS AGIGKATALEYLEASNGNMKLIL AARRLEKLEELKKTIDEEFPNAK VHVGQLDITQAEKIKPFIENLPEA FKDIDILINNAGKALGSERVGEIA TQDIQDVFDTNVTALINVTQAVL PIFQAKNSGDIVNLGLGGRQRRIP HRLHLLCFQVCRRCVH*QFEKGT DQHEDQSYLDRAGAG*DRVLTG QIQR**GTS*KRLQGHYAVDGRR RG*LNRIFHFQKAEHRGCRHPDL PHQPSLALPHLSRL* (SEQ ID NO: 701) The sequence came from a comparative genomics study using "draft" genome sequences with 7-fold coverage (Kellis et al, Nature 423: 241-254 2003)). |
| Saccharomyces castellii | AACF01000116 | 204, 205 |
| Saccharomyces mikatae | AACH01000019 | 206, 207 |
| Ashbya gossypii | AE016819 | 208, 209 |
| Candida glabrata | CR380959 | 210, 211 |
| Debaryomyces hansenii | CR382139 | 212, 213 |
| Scheffersomyces stipitis (formerly Pichia stipitis) | XM_001387479 | 214, 215 |

TABLE 5-continued

Example YMR226C Yeast Homologs

| Species | Accession # | SEQ ID NO: (nucleic acid, amino acid) |
| --- | --- | --- |
| *Meyerozyma guilliermondii* (formerly *Pichia guilliermondii*) | XM_001482184 | 216, 217 |
| *Vanderwaltozyma polyspora* (formerly *Kluyveromyces polysporus*) | XM_001645671 | 218, 219 |
| *Candida dubliniensis* | XM_002419771 | 220, 221 |
| *Zygosaccharomyces rouxii* | XM_002494574 | 222, 223 |
| *Lachancea thermotolerans* (formerly *Kluyveromyces thermotolerans*) | XM_002553230 | 224, 225 |
| *Kluyveromyces lactis* | XM_451902 | 226, 227 |
| *Saccharomyces kluyveri* | SAKL0H04730 | 228, 229 |
| *Yarrowia lipolytica* | XM_501554 | 230, 231 |
| *Schizosaccharomyces pombe* | NM_001018495 | 232, 233 |

In some embodiments, a polypeptide having acetolactate reductase activity is YMR226C or a homolog of YMR226C. Thus, in some embodiments, the polypeptide having acetolactate reductase activity is a polypeptide comprising a sequence listed in Table 5 or a sequence that is at least about 70%, at least about 75%, at least about 80%, at least about 85%, at least about 90%, at least about 95%, or at least about 99% identical to a polypeptide sequence listed in Table 5. In some embodiments, the polypeptide having acetolactate reductase activity is a polypeptide encoded by a polynucleotide sequence listed in Table 5 or a sequence that is at least about 70%, at least about 75%, at least about 80%, at least about 85%, at least about 90%, at least about 95%, or at least about 99% identical to a polynucleotide sequence listed in Table 5. Acetolactate reductases capable of converting acetolactate to DHMB can be identified, for example, by screening genetically altered yeast for changes in acetolactate consumption, changes in DHMB production, changes in DHIV production, or changes in other downstream product (e.g., butanol) production.

One way of identifying a gene involved in DHMB production comprises measuring the amount of DHMB produced by individual yeast strains in a yeast knock-out library. Knock-out libraries are available, for example, from Open Biosystems® (a division of Thermo Fisher Scientific, Waltham, Mass.). In this method, a decrease in DHMB production indicates that the gene that has been knocked-out functions to increase DHMB production, and an increase in DHMB production indicates that the gene that has been knocked-out functions to decrease DHMB production.

Two ways that a knockout ("KO") library can be used to identify candidate genes for involvement in DHMB synthesis include: (1) DHMB and DHIV accumulated in the culture during growth from endogenous substrates (acetolactate and NADPH or NADH) can be analyzed in samples from cultures. These samples can be placed in a hot (80-100° C.) water bath for 10-20 min, or diluted into a solution such as 2% formic acid that will kill and permeabilize the cells. After either treatment, small molecules will be found in the supernatant after centrifugation (5 min, 1100×g). The DHMB/DHIV ratio of a control strain (e.g., BY4743) can be compared to that of the different KO derivatives, and the gene(s) missing from any strain(s) with exceptionally low DHMB/DHIV ratios can encode acetolactate reductase (ALR). (2) DHMB and/or DHIV formation rates in vitro from exogenous substrates (acetolactate and NADH and/or NADPH) can be measured in timed samples taken from a suspension of permeabilized cells, and inactivated in either of the ways described above. Since the substrates for DHMB and DHIV synthesis are the same, this allows one to measure the relative levels of ALR and KARI activity in the sample.

Another way of identifying a gene involved in DHMB production comprises measuring the amount of DHMB produced by individual yeast strains in a yeast overexpression library. Overexpression libraries are available, for example, from Open Biosystems® (a division of Thermo Fisher Scientific, Waltham, Mass.). In this method, a decrease in DHMB production indicates that the overexpressed gene functions to decrease DHMB production, and an increase in DHMB production indicates that the overexpressed gene functions to increase DHMB production.

Another way of identifying a gene involved in DHMB production is to biochemically analyze a DHMB-producing yeast strain. For example, DHMB-producing cells can be disrupted. This disruption can be performed at low pH and cold temperatures. The cell lysates can be separated into fractions, e.g., by adding ammonium sulfate or other techniques known to those of skill in the art, and the resulting fractions can be assayed for enzymatic activity. For example, the fractions can be assayed for the ability to convert acetolactate to DHMB. Fractions with enzymatic activity can be treated by methods known in the art to purify and concentrate the enzyme (e.g., dialysis and chromatographic separation). When a sufficient purity and concentration is achieved, the enzyme can be sequenced, and the corresponding gene encoding the acetolactate reductase capable of converting acetolactate to DHMB can be identified.

Furthermore, since the reduction of acetolactate to DHMB occurs in yeast, but does not occur to the same extent in *E. coli*, acetolactate reductases that are expressed in yeast, but not expressed in *E. coli*, can be selected for screening. Selected enzymes can be expressed in yeast or other protein expression systems and screened for the capability to convert acetolactate to DHMB.

Enzymes capable of catalyzing the conversion of acetolactate to DHMB can be screened by assaying for acetolactate levels, by assaying for DHMB levels, by assaying for DHIV levels, or by assaying for any of the downstream products in the conversion of DHIV to butanol, including isobutanol.

DHMB can be measured using any technique known to those of skill in the art. For example, DHMB can be separated and quantified by methods known to those of skill in the art and techniques described in the Examples provided herein. For example, DHMB can be separated and quantified using liquid chromatography-mass spectrometry, liquid chromatography-nuclear magnetic resonance (NMR), thin-layer chromatography, and/or HPLC with UV/Vis detection.

In embodiments, selected acetolactate reductase polynucleotides, genes and/or polypeptides disclosed herein can be modified or disrupted. Many suitable methods are known to those of ordinary skill in the art and include those described for aldehyde dehydrogenase (above).

The modification of acetolactate reductase in a recombinant host cell disclosed herein to reduce or eliminate acetolactate reductase activity can be confirmed using methods known in the art. For example, the presence or absence of an acetolactate reductase-encoding polynucleotide sequence can be determined using PCR screening. A decrease in acetolactate reductase activity can also be determined based on a reduction in conversion of acetolactate to DHMB. A decrease in acetolactate reductase activity can also be determined based on a reduction in DHMB production. A decrease in acetolactate reductase activity can also be determined based on an increase in butanol production.

Thus, in some embodiments, a yeast that is capable of producing butanol produces no more than about 5 mM, about 4 mM, about 3 mM, to about 2 mM, about 1 mM, about 0.9 mM, about 0.8 mM, about 0.7 mM, about 0.6 mM, about 0.5 mM, about 0.4 mM or about 0.3 mM DHMB. In some embodiments, a yeast producing butanol produces no more than about 5 mM, about 4 mM, about 3 mM, about 2 mM, about 1 mM, about 0.9 mM, about 0.8 mM., about 0.7 mM, about 0.6 mM, about 0.5 mM, about 0.4 mM or about 0.3 mM DHMB. In some embodiments, a yeast producing butanol produces no more than about 0.2 mM or 0.2 mM DHMB.

In some embodiments, a yeast capable of producing butanol produces no more than about 10 mM DHMB when cultured under fermentation conditions for at least about 50 hours. In some embodiments, a yeast capable of producing butanol produces no more than about 5 mM DHMB when cultured under fermentation conditions for at least about 20 hours, at least about 25 hours, at least about 30 hours, at least about 35 hours, at least about 40 hours, at least about 45 hours, or at least about 50 hours. In some embodiments, a yeast capable of producing butanol produced no more than about 3 mM DHMB when cultured under fermentation conditions for at least about 5 hours, at least about 10 hours, at least about 15 hours, at least about 20 hours, at least about 25 hours, at least about 30 hours, at least about 35 hours, at least about 40 hours, at least about 45 hours, or at least about 50 hours.

In some embodiments, a yeast capable of producing butanol produced no more than about 1 mM DHMB when cultured under fermentation conditions for at least about 1 hour, at least about 5 hours, at least about 10 hours, at least about 15 hours, at least about 20 hours, at least about 25 hours, at least about 30 hours, at least about 35 hours, at least about 40 hours, at least about 45 hours, or at least about 50 hours. In some embodiments, a yeast capable of producing butanol produced no more than about 0.5 mM DHMB when cultured under fermentation conditions for at least about 1 hour, at least about 5 hours, at least about 10 hours, at least about 15 hours, at least about 20 hours, at least about 25 hours, at least about 30 hours, at least about 35 hours, at least about 40 hours, at least about 45 hours, or at least about 50 hours.

In some embodiments, a yeast comprising at least one deletion, mutation, and/or substitution in an endogenous polynucleotide encoding an acetolactate reductase produces no more than about 0.5 times, about 0.4 times, about 0.3 times, about 0.2 times, about 0.1 times, about 0.05 times the amount of DHMB produced by a yeast containing the endogenous polynucleotide encoding an acelotacatate reductase when cultured under fermentation conditions for the same amount of time.

In some embodiments, a yeast that is capable of producing butanol produces an amount of DHIV that is at least about 5 mM, at least about 6 mM, at least about 7 mM, at least about 8 mM, at least about 9 mM, or at least about 10 mM.

In some embodiments, a yeast that is capable of producing butanol produces an amount of DHIV that is at least about the amount of DHMB produced. In some embodiments, a yeast that is capable of producing butanol produces an amount of DHIV that is at least about twice, about three times, about five times, about ten times, about 15 times, about 20 times, about 25 times, about 30 times, about 35 times, about 40 times, about 45 times, or about 50 times the amount of DHMB produced.

In some embodiments, a yeast that is capable of producing butanol produces DHIV at a rate that is at least about equal to the rate of DHMB production. In some embodiments, a yeast that is capable of producing butanol produces DHIV at a rate that is at least about twice, about three times, about five times, about ten times, about 15 times, about 20 times, about 25 times, about 30 times, about 35 times, about 40 times, about 45 times, or about 50 times the rate of DHMB production.

In some embodiments, a yeast that is capable of producing butanol produces less than 0.010 moles of DHMB per mole of glucose consumed. In some embodiments, a yeast produces less than about 0.009, less than about 0.008, less than about 0.007, less than about 0.006, or less than about 0.005 moles of DHMB per mole of glucose consumed. In some embodiments, a yeast produces less than about 0.004, less than about 0.003, less than about 0.002, or less than about 0.001 moles of DHMB per mole of glucose consumed.

In some embodiments, acetolactate reductase activity is inhibited by chemical means. For example, acetolactate reductase could be inhibited using other known substrates such as those listed in Fujisawa et al. including L-serine, D-serine, 2-methyl-DL-serine, D-threonine, L-allothreonine, L-3-hydroxyisobutyrate, D-3-hydroxyisobutyrate, 3-hydroxypropionate, L-3-hydroxybutyrate, and D-3-hydroxybutyrate (Biochimica et Biophysica Acta 1645:89-94 (2003), which is herein incorporated by reference in its entirety).

DHMB Removal

In other embodiments described herein, a reduction in DHMB can be achieved by removing DHMB from a fermentation. Thus, fermentations with reduced DHMB concentrations are also described herein. Removal of DHMB can result, for example, in a product of greater purity, or a product requiring less processing to achieve a desired purity. Therefore, compositions comprising products of biosynthetic pathways such as ethanol or butanol with increased purity are also provided.

DHMB can be removed during or after a fermentation process and can be removed by any means known in the art.

DHMB can be removed, for example, by extraction into an organic phase or reactive extraction.

In some embodiments, the fermentation broth comprises less than about 0.5 mM DHMB. In some embodiments, the fermentation broth comprises less than about 1.0 mM DHMB after about 5 hours, about 10 hours, about 15 hours, about 20 hours, about 25 hours, about 30 hours, about 35 hours, about 40 hours, about 45 hours, or about 50 hours of fermentation. In some embodiments, the fermentation broth comprises less than about 5.0 mM DHMB after about 20 hours, about 25 hours, about 30 hours, about 35 hours, about 40 hours, about 45 hours, or about 50 hours of fermentation.

Biosynthetic Pathways

While the KARI variants presented herein are believed to be suitable for production of isobutanol, it is envisioned that KARIs disclosed herein may be useful in any biosynthetic pathway which employs a substrate to product conversion catalyzed by KARI activity such as acetolactate to 2,3-dihydroxyisovalerate or 2-aceto-2-hydroxybutanoate to 2,3-dihydroxy-3-methylpentanoate. Such pathways include, but are not limited to, pathways for producing pantothenic acid, valine, leucine, isoleucine or 3,3-dimethylmalate.

Certain suitable isobutanol biosynthetic pathways are disclosed in U.S. Pat. Nos. 7,851,188 and 7,993,889, each of which is incorporated by reference in their entireties herein. A diagram of the disclosed isobutanol biosynthetic pathways is provided in FIG. 1. As described in U.S. Pat. No. 7,851,188, steps in an example isobutanol biosynthetic pathway include conversion of:

pyruvate to acetolactate (see FIG. 1, pathway step a therein), as catalyzed for example by acetolactate synthase (ALS), acetolactate to 2,3-dihydroxyisovalerate (see FIG. 1, pathway step b therein) as catalyzed for example by acetohydroxy acid isomeroreductase (KARI);

2,3-dihydroxyisovalerate to 2-ketoisovalerate (see FIG. 1, pathway step c therein) as catalyzed for example by acetohydroxy acid dehydratase, also called dihydroxyacid dehydratase (DHAD);

2-ketoisovalerate to isobutyraldehyde (see FIG. 1, pathway step d therein) as catalyzed for example by branched-chain 2-keto acid decarboxylase; and isobutyraldehyde to isobutanol (see FIG. 1, pathway step e therein) as catalyzed for example by branched-chain alcohol dehydrogenase.

In another embodiment, the isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase;

α-ketoisovalerate to valine, which may be catalyzed, for example, by transaminase or valine dehydrogenase;

valine to isobutylamine, which may be catalyzed, for example, by valine decarboxylase;

isobutylamine to isobutyraldehyde, which may be catalyzed by, for example, omega transaminase; and, isobutyraldehyde to isobutanol, which may be catalyzed, for example, by a branched-chain alcohol dehydrogenase.

In another embodiment, the isobutanol biosynthetic pathway comprises the following substrate to product conversions:

pyruvate to acetolactate, which may be catalyzed, for example, by acetolactate synthase;

acetolactate to 2,3-dihydroxyisovalerate, which may be catalyzed, for example, by acetohydroxy acid reductoisomerase;

2,3-dihydroxyisovalerate to α-ketoisovalerate, which may be catalyzed, for example, by acetohydroxy acid dehydratase;

α-ketoisovalerate to isobutyryl-CoA, which may be catalyzed, for example, by branched-chain keto acid dehydrogenase;

isobutyryl-CoA to isobutyraldehyde, which may be catalyzed, for example, by acetylating aldehyde dehydrogenase; and, isobutyraldehyde to isobutanol, which may be catalyzed, for example, by a branched-chain alcohol dehydrogenase.

In another embodiment, the isobutanol biosynthetic pathway comprises the substrate to product conversions shown as steps k, g, and e in FIG. 1.

In another embodiment, the pathway comprising the substrate to product conversion catalyzed by KARI is a pantothenic acid biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to 2-dehydropantoate, which may be catalyzed, for example, by 3-methyl-2-oxobutanoate hydroxymethyltransferase (panB; which may be classified as EC 2.1.2.11);

2-dehydropantoate to (R)-pantoate, which may be catalyzed, for example by 2-dehydropantoate 2-reductase (panE; which may be classified as EC 1.1.1.169)

(R)-pantoate to (R)-pantothenate. which may be catalyzed, for example, by pantoate-beta-alanine ligase (panC; which may be classified as EC 6.3.2.1).

In another embodiment, the pathway comprising a substrate to product conversion catalyzed by KARI is a valine biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to valine, which may be catalyzed, for example, by branched chain aminotransferase (ilvE (BAT); which may be classified as EC 2.6.1.42).

In another embodiment, the pathway comprising a substrate to product conversion catalyzed by KARI is an isoleucine biosynthetic pathway comprising the following substrate to product conversions:

pyruvate and α-ketobutyrate to 2-aceto-2-hydroxybutanoate, which may be catalyzed for example, by acetolactate synthase;

2-aceto-2-hydroxybutanoate to 2,3-dihydroxy-3-methyl-pentanoate, which may be catalyzed for example, by KARI;

2,3-dihydroxy-3-methylpentanoate to 3-methyl-2-oxo-pentanoate, which may be catalyzed for example, by DHAD;

3-methyl-2-oxo-pentanoate to isoleucine, which may be catalyzed, for example, by branched chain aminotransferase (ilvE (BAT); which may be classified as EC 2.6.1.42).

In another embodiment, the pathway comprising a substrate to product conversion catalyzed by KARI is a leucine biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to 2-isopropylmalate, which may be catalyzed, for example, by 2-isopropylmalate synthase (leuA, which may be classified as EC 2.3.3.13);

2-isopropylmalate to 2-isopropylmaleate, which may be catalyzed, for example, by 3-isopropylmalate dehydratase (leu1; which may be classified as EC 4.2.1.33);

2-isopropylmaleate to 3-isopropylmalate, which may be catalyzed, for example, by 3-isopropylmalate dehydratase (leu1; which may be classified as EC 4.2.1.33);

3-isopropylmalate to 2-isopropyl-3-oxosuccinate, which may be catalyzed, for example by 3-isopropylmalate dehydrogenase (leuB; which may be classified as EC 1.1.1.85);

2-isopropyl-3-oxosuccinate to 4-methyl-2-oxopentanoate (spontaneous reaction); and 4-methyl-2-oxopentanoate to leucine, which may be catalyzed, for example, by branched chain aminotransferase (ilvE (BAT); which may be classified as EC 2.6.1.42)

In another embodiment, the pathway comprising a substrate to product conversion catalyzed by KARI is a 3,3-dimethylmalate biosynthetic pathway comprising the following substrate to product conversions:

pyruvate to acetolactate, which may be catalyzed, for example, by acetolactate synthase;

acetolactate to 2,3-dihydroxyisovalerate, which may be catalyzed, for example, by ketol-acid reductoisomerase (KARI);

2,3-dihydroxyisovalerate to α-ketoisovalerate, which may be catalyzed, for example, by dihydroxyacid dehydratase (DHAD);

α-ketoisovalerate to (R)-3,3 dimethylmalate, which may be catalyzed for example, by dimethylmalatedehydrogenase (DMMD; which may be classified as 1.1.1.84).

Genes and polypeptides that can be used for certain of the substrate to product conversions described above as well as those for additional isobutanol pathways, are available in the art. For example, described in U.S. Patent Appl. Pub. No. 2007/0092957 and PCT Pub. No. WO 2011/019894, both incorporated by reference in their entireties herein. US Appl. Pub. Nos. 2011/019894, 2007/0092957, 2010/0081154, which are herein incorporated by reference in their entireties, describe dihydroxyacid dehydratases including those from *Lactococcus lactis* and *Streptococcus mutans*. Ketoisovalerate decarboxylases include those derived from *Lactococcus lactis, Macrococcus caseolyticus* (SEQ ID NO: 171) and *Listeria grayi* (SEQ ID NO: 170). U.S. Patent Appl. Publ. No. 2009/0269823 and U.S. Appl. Publ. No. 2011/0269199, incorporated by reference in their entireties, describe alcohol dehydrogenases, including those that utilize NADH as a cofactor. Alcohol dehydrogenases include SadB from *Achromobacter xylosoxidans*. Additional alcohol dehydrogenases include horse liver ADH and *Beijerinkia indica* ADH. Alcohol dehydrogenases include those that utilize NADH as a cofactor. In one embodiment an isobutanol biosynthetic pathway comprises a) a ketol-acid reductoisomerase that has a $K_M$ for NADH less than about 300 µM, less than about 100 µM, less than about 50 µM, less than about 20 µM or less than about 10 µM; b) an alcohol dehydrogenase that utilizes NADH as a cofactor; or c) both a) and b).

WO 2011/019894 and U.S. Appl. Pub. Nos. 2011/019894, 2007/0092957, 2010/0081154, which are herein incorporated by reference in their entireties, describe suitable dihydroxyacid dehydratases. Methods of increasing DHAD activity are described, for example, in U.S. Appl. Pub. Nos. 2010/0081173 and 2012/0064561A1, which are herein incorporated by reference in their entireties.

Additional genes that can be used can be identified by one skilled in the art through bioinformatics or using methods well-known in the art.

Additionally described in U.S. Appl. Pub. No. US 2007/0092957 A1, which is incorporated by reference herein in its entirety, are construction of chimeric genes and genetic engineering of bacteria and yeast for isobutanol production using the disclosed isobutanol biosynthetic pathways. Such construction and engineering methods could be readily employed by those of ordinary skill in the art to construct other pathways disclosed herein and/or known in the art which include a substrate to product conversion catalyzed by KARI activity.

Suitable ketol-acid reductoisomerase (KARI) enzymes are described elsewhere herein. In some embodiments, the KARI enzyme has a specific activity of at least about 0.1 micromoles/min/mg, at least about 0.2 micromoles/min/mg, at least about 0.3 micromoles/min/mg, at least about 0.4 micromoles/min/mg, at least about 0.5 micromoles/min/mg, at least about 0.6 micromoles/min/mg, at least about 0.7 micromoles/min/mg, at least about 0.8 micromoles/min/mg, at least about 0.9 micromoles/min/mg, at least about 1.0 micromoles/min/mg, or at least about 1.1 micromoles/min/mg. Suitable polypeptides to catalyze the substrate to product conversion acetolactate to 2,3-dihydroxyisovalerate include those that that have a $K_M$ for NADH less than about 300 µM, less than about 100 µM, less than about 50 µM, less than about 25 µM or less than about 10 µM.

Modifications

Functional deletion of the pyruvate decarboxylase gene has been used to increase the availability of pyruvate for utilization in biosynthetic product pathways. For example, U.S. Application Publication No. US 2007/0031950 A1, which is herein incorporated by reference in its entirety, discloses a yeast strain with a disruption of one or more pyruvate decarboxylase genes and expression of a D-lactate dehydrogenase gene, which is used for production of D-lactic acid. U.S. Appl. Pub. No. U.S. 2005/0059136 A1, which is herein incorporated by reference in its entirety, discloses glucose tolerant two carbon source independent (GCSI) yeast strains with no pyruvate decarboxylase activity, which can have an exogenous lactate dehydrogenase gene. Nevoigt and Stahl (Yeast 12:1331-1337 (1996)) describe the impact of reduced pyruvate decarboxylase and increased NAD-dependent glycerol-3-phosphate dehydrogenase in *Saccharomyces cerevisiae* on glycerol yield. U.S. Appl. Pub. No. 2009/0305363, which is herein incorporated by reference in its entirety, discloses increased conversion of pyruvate to acetolactate by engineering yeast for expression of a cytosol-localized acetolactate synthase and substantial elimination of pyruvate decarboxylase activity.

In embodiments of the invention, a recombinant host cell disclosed herein can comprise a modification in an endogenous polynucleotide encoding a polypeptide having pyruvate decarboxylase (PDC) activity or a modification in an endogenous polypeptide having PDC activity. In embodiments, a recombinant host cell disclosed herein can have a modification or disruption of a polynucleotide, gene and/or polypeptide encoding PDC. In embodiments, a recombinant host cell comprises a deletion, mutation, and/or substitution in an endogenous polynucleotide or gene encoding a polypeptide having PDC activity, or in an endogenous polypeptides having PDC activity. Such modifications, disruptions, deletions, mutations, and/or substitutions can result in PDC activity that is reduced or eliminated, resulting, for example, in a PDC knock-out (PDC-KO) phenotype.

In embodiments of the invention, an endogenous pyruvate decarboxylase activity of a recombinant host cell disclosed herein converts pyruvate to acetaldehyde, which can then be converted to ethanol or to acetyl-CoA via acetate. In other embodiments, a recombinant host cell is *Kluyveromyces lactis* containing one gene encoding pyruvate decarboxylase, *Candida glabrata* containing one gene encoding pyruvate decarboxylase, or *Schizosaccharomyces pombe* containing one gene encoding pyruvate decarboxylase.

In other embodiments, a recombinant host cell is *Saccharomyces cerevisiae* containing three isozymes of pyruvate decarboxylase encoded by the PDC1, PDC5, and PDC6 genes, as well as a pyruvate decarboxylase regulatory gene, PDC2. In a non-limiting example in *S. cerevisiae*, the PDC1 and PDC5 genes, or the PDC1, PDC5, and PDC6 genes, are disrupted. In another non-limiting example in *S. cerevisiae*, pyruvate decarboxylase activity can be reduced by disrupting the PDC2 regulatory gene. In another non-limiting example in *S. cerevisiae*, polynucleotides or genes encoding pyruvate decarboxylase proteins such as those having about 70% to about 75%, about 75% to about 80%, about 80% to about 85%, about 85% to about 90%, about 90% to about 95%, about 96%, about 97%, about 98%, or about 99% sequence identity to PDC1, PDC2, PDC5 and/or PDC6 can be disrupted.

In embodiments, a polypeptide having PDC activity or a polynucleotide or gene encoding a polypeptide having PDC activity corresponds to Enzyme Commission Number EC 4.1.1.1. In other embodiments, a PDC gene of a recombinant host cell disclosed herein is not active under the fermentation conditions used, and therefore such a gene would not need to be modified or inactivated.

Examples of recombinant host cells with reduced pyruvate decarboxylase activity due to disruption of pyruvate decarboxylase encoding genes have been reported, such as for *Saccharomyces* in Flikweert et al. (Yeast (1996) 12:247-257), for *Kluyveromyces* in Bianchi et al. (Mol. Microbiol. (1996) 19(1):27-36), and disruption of the regulatory gene in Hohmann (Mol. Gen. Genet. (1993) 241:657-666). *Saccharomyces* strains having no pyruvate decarboxylase activity are available from the ATCC with Accession #200027 and #200028. Examples of PDC polynucleotides, genes and/or polypeptides that can be targeted for modification or inactivation in the recombinant host cells disclosed herein include, but are not limited to, those of the following Table 6.

TABLE 6

Pyruvate decarboxylase target gene coding regions and proteins.

| Description | SEQ ID NO: Nucleic acid | SEQ ID NO: Amino acid |
|---|---|---|
| PDC1 pyruvate decarboxylase from *Saccharomyces cerevisiae* | 234 | 235 |
| PDC5 pyruvate decarboxylase from *Saccharomyces cerevisiae* | 236 | 237 |
| PDC6 pyruvate decarboxylase from *Saccharomyces cerevisiae* | 238 | 239 |
| pyruvate decarboxylase from *Candida glabrata* | 240 | 241 |
| PDC1 pyruvate decarboxylase from *Pichia stipitis* | 242 | 243 |
| PDC2 pyruvate decarboxylase from *Pichia stipitis* | 244 | 245 |
| pyruvate decarboxylase from *Kluyveromyces lactis* | 246 | 247 |
| pyruvate decarboxylase from *Yarrowia lipolytica* | 248 | 249 |
| pyruvate decarboxylase from *Schizosaccharomyces pombe* | 250 | 251 |
| pyruvate decarboxylase from *Zygosaccharomyces rouxii* | 252 | 253 |

Other examples of PDC polynucleotides, genes and polypeptides that can be targeted for modification or inactivation in a recombinant host cell disclosed herein include, but are not limited to, PDC polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 6, wherein such a polynucleotide or gene encodes, or such a polypeptide has, PDC activity. Still other examples of PDC polynucleotides, genes and polypeptides that can be targeted for modification or inactivation in a recombinant host cell disclosed herein include, but are not limited to an active variant, fragment or derivative of any one of the sequences of Table 6, wherein such a polynucleotide or gene encodes, or such a polypeptide has, PDC activity.

In embodiments, a polynucleotide, gene and/or polypeptide encoding a PDC sequence disclosed herein or known in the art can be modified, as disclosed above for aldehyde dehydrogenase. In other embodiments, a polynucleotide, gene and/or polypeptide encoding PDC can be used to identify another PDC polynucleotide, gene and/or polypeptide sequence or to identify a PDC homolog in other cells, as disclosed above for acetolactate dehydrogenase. Such a PDC encoding sequence can be identified, for example, in the literature and/or in bioinformatics databases well known to the skilled person. For example, the identification of a PDC encoding sequence in other cell types using bioinformatics can be accomplished through BLAST (as described above) searching of publicly available databases with a known PDC encoding DNA and polypeptide sequence, such as those provided herein. Identities are based on the Clustal W method of alignment using the default parameters of GAP PENALTY=10, GAP LENGTH PENALTY=0.1, and Gonnet 250 series of protein weight matrix.

The modification of PDC in a recombinant host cell disclosed herein to reduce or eliminate PDC activity can be confirmed using methods known in the art. For example, disruption of a particular pyruvate decarboxylase could be confirmed with PCR screening using primers external to the gene sequence, or by Southern blot using a probe designed to the pyruvate decarboxylase gene sequence. Alternatively, one could utilize analytical methods such as gas chromatography or HPLC to screen strains for decreased or eliminated production of acetaldehyde and/or ethanol.

Functional deletion of the hexokinase 2 gene has been used to reduce glucose repression and to increase the availability of pyruvate for utilization in biosynthetic pathways. For example, International Publication No. WO 2000/061722 A1, which is incorporated herein by reference in its entirety discloses the production of yeast biomass by aerobically growing yeast having one or more functionally deleted hexokinase 2 genes or analogs. In addition, Rossell et al. (Yeast Research 8:155-164 (2008)) found that *Saccharomyces cerevisiae* with a deletion of the hexokinase 2 gene showed 75% reduction in fermentative capacity, defined as the specific rate of carbon dioxide production under sugar-excess and anaerobic conditions. After starvation, the fermentation capacity was similar to that of a strain without the hexokinase 2 gene deletion. Diderich et al. (Applied and Environmental Microbiology 67:1587-1593 (2001)) found that *S. cerevisiae* with a deletion of the hexokinase 2 gene had lower pyruvate decarboxylase activity.

In embodiments, a recombinant host cell disclosed herein can comprise a modification in an endogenous polynucleotide encoding a polypeptide having hexokinase 2 activity and/or a modification in a polypeptide having hexokinase 2 activity. In embodiments, a recombinant host cell disclosed herein can have a modification or disruption of a polynucleotide, gene or polypeptide encoding hexokinase 2. In embodiments, a recombinant host cell comprises a deletion, mutation, and/or substitution in an endogenous polynucleotide or gene encoding a polypeptide having hexokinase 2 activity, or an endogenous polypeptide having hexokinase 2 activity. Such modifications, disruptions, deletions, mutations, and/or substitutions can result in hexokinase 2 activity that is reduced or eliminated, resulting, for example, in a hexokinase 2 knockout (HXK2-KO) phenotype. In embodiments, the host cell comprises a modification as described in U.S. Appn. Serial. Nos. 2011/0124060 A1 or 2012/0015416 A1, which are incorporated herein by reference in their entireties.

In embodiments, a polypeptide having hexokinase 2 activity can catalyze the conversion of hexose to hexose-6-phosphate, and/or can catalyze the conversion of D-glucose to D-glucose 6-phosphate, D-fructose to D-fructose 6-phosphate, and/or D-mannose to D-mannose 6-phosphate. In other embodiments, a polynucleotide, gene or polypeptide having hexokinase 2 activity can correspond to Enzyme Commission Number EC 2.7.1.1.

In embodiments of the invention, a recombinant host cell can be *S. cerevisiae* and a polynucleotide, gene or polypeptide having hexokinase 2 activity can be HXK2. In other embodiments, a recombinant host cell can be *K. lactis* and a polynucleotide, gene or polypeptide having hexokinase 2 activity can be RAG5. In other embodiments, a recombinant host cell can be *H. polymorpha* and a polynucleotide, gene or polypeptide having hexokinase 2 activity can be HPGLKI. In other embodiments, a recombinant host cell can be *S. pombe* and a polynucleotide, gene or polypeptide having hexokinase 2 activity can be HXK2.

Examples of hexokinase 2 polynucleotides, genes and polypeptides that can be targeted for modification or inactivation in a recombinant host cell disclosed herein include, but are not limited to, those of the following Table 7.

TABLE 7

| Hexokinase 2 target gene coding regions and proteins. | |
|---|---|
| HXK2 from *S. cerevisiae* | Nucleic acid (SEQ ID NO: 254) |
|  | Amino acid (SEQ ID NO: 255) |
| RAG5 from *K. lactis* | Nucleic acid (SEQ ID NO: 256) |
|  | Amino acid (SEQ ID NO: 257) |
| HPGLK1 from *H. polymorpha* | Nucleic acid (SEQ ID NO: 258) |
|  | Amino acid (SEQ ID NO: 259) |
| HXK2 from *S. pombe* | Nucleic acid (SEQ ID NO: 260) |
|  | Amino acid (SEQ ID NO: 261) |

Other examples of hexokinase 2 polynucleotides, genes and polypeptides that can be targeted for modification or inactivation in a recombinant host cell disclosed herein include, but are not limited to, hexokinase 2 polynucleotides, genes and/or polypeptides having at least about 70% to about 75%, about 75% to about 80%, about 80% to about 85%, about 85% to about 90%, about 90% to about 95%, about 96%, about 97%, about 98%, or about 99% sequence identity to any one of the sequences of Table 9, wherein such a polynucleotide or gene encodes, or such a polypeptide has, hexokinase 2 activity. Still other examples of hexokinase 2 polynucleotides, genes and polypeptides that can be targeted for modification or inactivation in a recombinant host cell disclosed herein include, but are not limited to an active variant, fragment or derivative of any one of the sequences of Table 7, wherein such a polynucleotide or gene encodes, or such a polypeptide has, hexokinase 2 activity.

In embodiments, a polynucleotide, gene and/or polypeptide encoding a hexokinase 2 sequence disclosed herein or known in the art can be modified or disrupted, as disclosed above for aldehyde dehydrogenase. In other embodiments, a polynucleotide, gene and/or polypeptide encoding hexokinase 2 can be used to identify another hexokinase 2 polynucleotide, gene and/or polypeptide sequence or to identify a hexokinase 2 homolog in other cells, as disclosed above for aldehyde dehydrogenase. Such a hexokinase 2 encoding sequence can be identified, for example, in the literature and/or in bioinformatics databases well known to the skilled person. For example, the identification of a hexokinase 2 encoding sequence in other cell types using bioinformatics can be accomplished through BLAST (as described above) searching of publicly available databases with a known hexokinase 2 encoding DNA and polypeptide sequence, such as those provided herein. Identities are based on the Clustal W method of alignment using the default parameters of GAP PENALTY=10, GAP LENGTH PENALTY=0.1, and Gonnet 250 series of protein weight matrix.

The modification of hexokinase 2 in a recombinant host cell disclosed herein to reduce or eliminate hexokinase 2 activity can be confirmed using methods known in the art. For example, disruption of hexokinase 2 could be confirmed with PCR screening using primers external to the hexokinase 2 gene, or by Southern blot using a probe designed to the hexokinase 2 gene sequence. Alternatively, one could examine putative hexokinase 2 knockout strains for increased biomass yield on glucose-containing media.

Examples of additional modifications that can be useful in cells provided herein include modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Patent Appl. Pub. No. 2009/0305363 (incorporated herein by reference in its entirety), modifications to a host cell that provide for increased carbon flux through an Entner-Doudoroff Pathway or reducing equivalents balance as described in U.S. Patent Appl. Pub. No. 2010/0120105 (incorporated herein by reference in its entirety). Other modifications include integration of at least one polynucleotide encoding a polypeptide that catalyzes a step in a pyruvate-utilizing biosynthetic pathway described in PCT Appn. Pub. No. WO 2012/033832, which is herein incorporated by reference in its entirety. A genetic modification which has the effect of reducing glucose repression wherein the yeast production host cell is pdc—is described in U.S. Appl. Publ No. US 2011/0124060, which is herein incorporated by reference in its entirety.

U.S. Appl. Publ. No. 20120064561A1, which is herein incorporated by reference in its entirety, discloses recombinant host cells comprising (a) at least one heterologous polynucleotide encoding a polypeptide having dihydroxy-acid dehydratase activity: and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis. In embodiments, the polypeptide affecting Fe—S cluster biosynthesis is encoded by AFT1, AFT2, FRA2, GRX3, or CCC1 In embodiments, the polypeptide affecting Fe—S cluster biosynthesis is constitutive mutant AFT1 L99A, AFT1 L102A, AFT1 C291F, or AFT1 C293F.

Additionally, host cells can comprise heterologous polynucleotides encoding a polypeptides with phosphoketolase activity and/or a heterologous polynucleotide encoding a polypeptide with phosphotransacetylase activity such as, for example, those encoded by SEQ ID NOs: 262 and 263, and as described in PCT Appn. Pub. No. WO 2011/159853 and U.S. Appl. Publ. No. 20120156735A1, which are herein incorporated by reference in their entireties.

Microbial Hosts for Isobutanol Production

Microbial hosts for isobutanol production can be selected from bacteria, cyanobacteria, filamentous fungi and yeasts. The microbial host used for butanol production should be tolerant to isobutanol so that the yield is not limited by butanol toxicity. Although butanol-tolerant mutants have been isolated from solventogenic Clostridia, little information is available concerning the butanol tolerance of other potentially useful bacterial strains. Most of the studies on the comparison of alcohol tolerance in bacteria suggest that butanol is more toxic than ethanol (de Cavalho, et al., Microsc. Res. Tech., 64: 215-22, 2004) and (Kabelitz, et at, FEMS Microbiol. Lett., 220: 223-227, 2003, Tomas, et al., J. Bacteriol., 186: 2006-2018, 2004) report that the yield of 1-butanol during fermentation in Clostridium acetobutylicum can be limited by 1-butanol toxicity. The primary effect of 1-butanol on Clostridium acetobutylicum is disruption of membrane functions (Hermann et al., Appl. Environ. Microbial., 50: 1238-1243, 1985).

The microbial hosts selected for the production of isobutanol should be tolerant to isobutanol and should be able to convert carbohydrates to isobutanol. The criteria for selection of suitable microbial hosts include the following: intrinsic tolerance to isobutanol, high rate of glucose utilization, availability of genetic tools for gene manipulation, and the ability to generate stable chromosomal alterations.

Suitable host strains with a tolerance for isobutanol can be identified by screening based on the intrinsic tolerance of the strain. The intrinsic tolerance of microbes to isobutanol can be measured by determining the concentration of isobutanol that is responsible for 50% inhibition of the growth rate (IC50) when grown in a minimal medium. The IC50 values can be determined using methods known in the art. For example, the microbes of interest can be grown in the presence of various amounts of isobutanol and the growth rate monitored by measuring the optical density at 600 nanometers. The doubling time can be calculated from the logarithmic part of the growth curve and used as a measure of the growth rate. The concentration of isobutanol that produces 50% inhibition of growth can be determined from a graph of the percent inhibition of growth versus the isobutanol concentration. In one embodiment, the host strain has an $IC_{50}$ for isobutanol of greater than about 0.5%.

The microbial host for isobutanol production should also utilize glucose at a high rate. Most microbes are capable of metabolizing carbohydrates. However, certain environmental microbes cannot metabolize carbohydrates to high efficiency, and therefore would not be suitable hosts.

The ability to genetically modify the host is essential for the production of any recombinant microorganism. The mode of gene transfer technology can be by electroporation, conjugation, transduction or natural transformation. A broad range of host conjugative plasmids and drug resistance markers are available. The cloning vectors are tailored to the host microorganisms based on the nature of antibiotic resistance markers that can function in that host.

The microbial host also has to be manipulated in order to inactivate competing pathways for carbon flow by deleting various genes. This requires the availability of either transposons to direct inactivation or chromosomal integration vectors. Additionally, the production host should be amenable to chemical mutagenesis so that mutations to improve intrinsic isobutanol tolerance can be obtained.

Based on the criteria described above, suitable microbial hosts for the production of isobutanol include, but are not limited to, members of the genera Clostridium, Zymomonas, Escherichia, Salmonella, Rhodococcus, Pseudomonas, Bacillus, Vibrio, Lactobacillus, Enterococcus, Alcaligenes, Klebsiella, Paenibacillus, Arthrobacter, Corynebacterium, Brevibacterium, Pichia, Candida, Issatchenkia, Hansenula, Kluyveromyces, and Saccharomyces. Suitable hosts include: Escherichia coli, Alcaligenes eutrophus, Bacillus licheniformis, Paenibacillus macerans, Rhodococcus etythropolis, Pseudomonas putida, Lactobacillus plantarum, Enterococcus faecium, Enterococcus gallinarium, Enterococcus faecalis, Bacillus subtilis and Saccharomyces cerevisiae. In some embodiments, the host cell is Saccharomyces cerevisiae. S. cerevisiae yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. S. cerevisiae include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Construction of Production Host

Recombinant microorganisms containing the necessary genes that will encode the enzymatic pathway for the conversion of a fermentable carbon substrate to butanol can be constructed using techniques well known in the art. In the present invention, genes encoding the enzymes of one of the isobutanol biosynthetic pathways of the invention, for example, acetolactate synthase, acetohydroxy acid isomeroreductase, acetohydroxy acid dehydratase, branched-chain α-keto acid decarboxylase, and branched-chain alcohol dehydrogenase, can be isolated from various sources, as described above.

Methods of obtaining desired genes from a genome are common and well known in the art of molecular biology. For example, if the sequence of the gene is known, suitable genomic libraries can be created by restriction endonuclease digestion and can be screened with probes complementary to the desired gene sequence. Once the sequence is isolated, the DNA can be amplified using standard primer-directed amplification methods such as polymerase chain reaction (U.S. Pat. No. 4,683,202) to obtain amounts of DNA suitable for transformation using appropriate vectors. Tools for codon optimization for expression in a heterologous host are readily available. Some tools for codon optimization are available based on the GC content of the host microorganism.

Once the relevant pathway genes are identified and isolated they can be transformed into suitable expression hosts by means well known in the art. Vectors or cassettes useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. Both control regions can be derived from genes homologous to the transformed host cell, although it is to be understood that such control regions can also be derived from genes that are not native to the specific species chosen as a production host.

Initiation control regions or promoters, which are useful to drive expression of the relevant pathway coding regions in the desired host cell are numerous and familiar to those skilled in the art. Virtually any promoter capable of driving these genetic elements, including those used in the Examples, is suitable for the present invention including, but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, ara, tet, trp, $IP_L$, $IP_R$, T7, tac, and trc (useful for expression in *Escherichia coli, Alcaligenes*, and *Pseudomonas*) as well as the amy, apr, npr promoters and various phage promoters useful for expression in *Bacillus subtilis, Bacillus licheniformis*, and *Paenibacillus macerans*. For yeast recombinant host cells, a number of promoters can be used in constructing expression cassettes for genes, including, but not limited to, the following constitutive promoters suitable for use in yeast: FBA1, TDH3 (GPD), ADH1, ILV5, and GPM1; and the following inducible promoters suitable for use in yeast: GAL1, GAL10, OLE1, and CUP1. Other yeast promoters include hybrid promoters UAS(PGK1)-FBA1p (SEQ ID NO: 264), UAS(PGK1)-ENO2p (SEQ ID NO: 265), UAS(FBA1)-PDC1p (SEQ ID NO: 266), UAS(PGK1)-PDC1p (SEQ ID NO: 267), and UAS(PGK)-OLE1p (SEC) ID NO: 268).

Promoters, transcriptional terminators, and coding regions can be cloned into a yeast 2 micron plasmid and transformed into yeast cells (Ludwig, et al. Gene, 132: 33-40, 1993; US Appl. Pub. No. 20080261861A1).

Adjusting the amount of gene expression in a given host may be achieved by varying the level of transcription, such as through selection of native or artificial promoters. In addition, techniques such as the use of promoter libraries to achieve desired levels of gene transcription are well known in the art. Such libraries can be generated using techniques known in the art, for example, by cloning of random cDNA fragments in front of gene cassettes (Goh et al. (2002) *AEM* 99, 17025), by modulating regulatory sequences present within promoters (Ligr et al. (2006) *Genetics* 172, 2113), or by mutagenesis of known promoter sequences (Alper et al. (2005) *PNAS*, 12678; Nevoigt et al. (2005) *AEM* 72, 5266).

Termination control regions can also be derived from various genes native to the hosts. Optionally, a termination site can be unnecessary or can be included.

Certain vectors are capable of replicating in a broad range of host bacteria and can be transferred by conjugation. The complete and annotated sequence of pRK404 and three related vectors-pRK437, pRK442, and pRK442(H) are available. These derivatives have proven to be valuable tools for genetic manipulation in Gram-negative bacteria (Scott et al., Plasmid, 50: 74-79, 2003). Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for the heterologous gene expression in Gram-negative bacteria.

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., J. Bacteriol., 174: 5633-5638, 1992). Additionally, in vitro transposomes are available to create random mutations in a variety of genomes from commercial sources such as EPICENTRE®.

The expression of a butanol biosynthetic pathway in various microbial hosts is described in more detail below.

Expression of a Butanol Biosynthetic Pathway in *E. Coli*

Vectors or cassettes useful for the transformation of *E. coli* are common and commercially available from the companies listed above. For example, the genes of an isobutanol biosynthetic pathway can be isolated from various sources, cloned into a modified pUC19 vector and transformed into *E. coli* NM522.

Expression of a Butanol Biosynthetic Pathway in *Rhodococcus Erythropolis*

A series of *E. coli-Rhodococcus* shuttle vectors are available for expression in *R. erythropolis*, including, but not limited to, pRhBR17 and pDA71 (Kostichka et al., Appl. Microbial. Biotechnol., 62: 61-68, 2003). Additionally, a series of promoters are available for heterologous gene expression in *R. erythropolis* (Nakashima et al., Appl. Environ. Microbiol., 70: 5557-5568, 2004 and Tao et al., Appl. Microbiol. Biotechnol., 68: 346-354, 2005). Targeted gene disruption of chromosomal genes in *R. erythropolis* can be created using the method described by Tao et al., supra, and Brans et al. (Appl. Environ. Microbiol., 66: 2029-2036, 2000).

The heterologous genes required for the production of isobutanol, as described above, can be cloned initially in pDA71 or pRhBR71 and transformed into *E. coli*. The vectors can then be transformed into *R. erythropolis* by electroporation, as described by Kostichka et al., supra. The recombinants can be grown in synthetic medium containing glucose and the production of isobutanol can be followed using methods known in the art.

Expression of a Butanol Biosynthetic Pathway in *B. Subtilis*

Methods for gene expression and creation of mutations in *B. subtilis* are also well known in the art. For example, the genes of an isobutanol biosynthetic pathway can be isolated from various sources, cloned into a modified pUC19 vector and transformed into *Bacillus subtilis* BE1010. Additionally, the five genes of an isobutanol biosynthetic pathway can be split into two operons for expression. The three genes of the pathway (bubB, ilvD, and kivD) can be integrated into the chromosome of *Bacillus subtilis* BE1010 (Payne, et al., J. Bacteriol., 173, 2278-2282, 1991). The remaining two genes (ilvC and bdhB) can be cloned into an expression vector and transformed into the *Bacillus* strain carrying the integrated isobutanol genes Expression of a Butanol Biosynthetic Pathway in *B. Licheniformis*

Most of the plasmids and shuttle vectors that replicate in *B. subtilis* can be used to transform *B. licheniformis* by either protoplast transformation or electroporation. The genes required for the production of isobutanol can be cloned in plasmids pBE20 or pBE60 derivatives (Nagarajan et al., Gene, 114: 121-126, 1992). Methods to transform *B. licheniformis* are known in the art (Fleming et al. Appl. Environ, Microbiol., 61: 3775-3780, 1995). The plasmids constructed for expression in *B. subtilis* can be transformed into *B. licheniformis* to produce a recombinant microbial host that produces isobutanol.

Expression of a Butanol Biosynthetic Pathway in *Paenibacillus Macerans*

Plasmids can be constructed as described above for expression in *B. subtilis* and used to transform *Paenibacillus macerans* by protoplast transformation to produce a recombinant microbial host that produces isobutanol.

Expression of the Butanol Biosynthetic Pathway in *Alcaligenes* (*Ralstonia*) *Eutrophus*

Methods for gene expression and creation of mutations in *Alcaligenes eutrophus* are known in the art (Taghavi et al., Appl. Environ. Microbiol., 60: 3585-3591, 1994). The genes for an isobutanol biosynthetic pathway can be cloned in any of the broad host range vectors described above, and electroporated to generate recombinants that produce isobutanol. The poly(hydroxybutyrate) pathway in *Alcaligenes* has been described in detail, a variety of genetic techniques to modify the *Alcaligenes* eutrophus genome is known, and those tools can be applied for engineering an isobutanol biosynthetic pathway.

Expression of a Butanol Biosynthetic Pathway in *Pseudomonas putida*

Methods for gene expression in *Pseudomonas putida* are known in the art (see for example Ben-Bassat et al., U.S. Pat. No. 6,586,229, which is incorporated herein by reference). The butanol pathway genes can be inserted into pPCU18 and this ligated DNA can be electroporated into electrocompetent *Pseudomonas putida* DOT-T1 C5aAR1 cells to generate recombinants that produce isobutanol.

Expression of a Butanol Biosynthetic Pathway in *Saccharomyces cerevisiae*

Methods for gene expression in *Saccharomyces cerevisiae* are known in the art (e.g., *Methods in Enzymology*, Volume 194, *Guide to Yeast Genetics and Molecular and Cell Biology*, Part A, 2004, Christine Guthrie and Gerald R. Fink, eds., Elsevier Academic Press, San Diego, Calif.). Expression of genes in yeast typically requires a promoter, followed by the gene of interest, and a transcriptional terminator. A number of yeast promoters, including those used in the Examples herein, can be used in constructing expression cassettes for genes encoding an isobutanol biosynthetic pathway, including, but not limited to constitutive promoters FBA, GPD, ADH1, and GPM, and the inducible promoters GAL1, GAL10, and CUP1. Suitable transcriptional terminators include, but are not limited to FBAt, GPDt, GPMt, ERG10t, GAL1t, CYC1, and ADH1. For example, suitable promoters, transcriptional terminators, and the genes of an isobutanol biosynthetic pathway can be cloned into *E. coli*-yeast shuttle vectors and transformed into yeast cells as described in U.S. App. Pub. No. 20100129886. These vectors allow strain propagation in both *E. coli* and yeast strains. Typically the vector contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425) and Ura3 (vector pRS426). Construction of expression vectors with genes encoding polypeptides of interest can be performed by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a ≥21 bp sequence at both the 5' and the 3' ends that sequentially overlap with each other, and with the 5' and 3' terminus of the vector DNA. For example, to construct a yeast expression vector for "Gene X', a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, e.g. TOP10, followed by mini preps and restriction mapping to further verify the plasmid construct. Finally the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y", the promoter-coding regionX-terminator construct is PCR amplified from a plasmid DNA construct and joined to an autotrophic marker (such as URA3) by either SOE PCR or by common restriction digests and cloning. The full cassette, containing the promoter-coding regionX-terminator-URA3 region, is PCR amplified with primer sequences that contain 40-70 bp of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Expression of a Butanol Biosynthetic Pathway in *Lactobacillus plantarum*

The *Lactobacillus* genus belongs to the Lactobacillales family and many plasmids and vectors used in the transformation of *Bacillus subtilis* and *Streptococcus* can be used for *Lactobacillus*. Non-limiting examples of suitable vectors include pAMβ1 and derivatives thereof (Renault et al., Gene 183:175-182, 1996); and (O'Sullivan et al., Gene, 137: 227-231, 1993); pMBB1 and pHW800, a derivative of pMBB1 (Wyckoff et al., Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38: 1899-1903, 1994). Several plasmids from *Lactobacillus plantarum* have also been reported (van Kranenburg R, et al. Appl. Environ. Microbiol., 71: 1223-1230, 2005).

Expression of a Butanol Biosynthetic Pathway in Various *Enterococcus* Species (*E. Faecium, E. Gallinarium*, and *E. Faecalis*)

The *Enterococcus* genus belongs to the Lactobacillales family and many plasmids and vectors used in the transformation of *Lactobacilli, Bacilli* and *Streptococci* species can be used for *Enterococcus* species. Non-limiting examples of suitable vectors include pAMβ1 and derivatives thereof (Renault et al., Gene, 183: 175-182, 1996); and (O'Sullivan et al., Gene, 137: 227-231, 1993); pMBB1 and pHW800, a derivative of pMBB1 (Wyckoff et al. Appl. Environ. Microbiol., 62: 1481-1486, 1996); pMG1, a conjugative plasmid (Tanimoto et al., J. Bacteriol., 184: 5800-5804, 2002); pNZ9520 (Kleerebezem et al., Appl. Environ. Microbiol., 63: 4581-4584, 1997); pAM401 (Fujimoto et al., Appl. Environ. Microbiol., 67: 1262-1267, 2001); and pAT392 (Arthur et al., Antimicrob. Agents Chemother., 38:, 1899-1903, 1994). Expression vectors for *E. faecalis* using the nisA gene from *Lactococcus* can also be used (Eichenbaum et al., Appl. Environ. Microbiol., 64: 2763-2769, 1998). Additionally, vectors for gene replacement in the *E. faecium* chromosome can be used (Nallapareddy et al., Appl. Environ. Microbiol., 72: 334-345, 2006).

Fermentation Media

Fermentation media in the present invention must contain suitable carbon substrates. Suitable substrates can include but are not limited to monosaccharides such as glucose and fructose, oligosaccharides such as lactose, maltose, galactose, sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate can also be one-carbon substrates such as carbon dioxide, or methanol for which metabolic conversion into key biochemical intermediates has been demonstrated. In addition to one and two carbon substrates methylotrophic microorganisms are also known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., *Microb. Growth C1 Compd.*, [Int. Symp.], 7th (1993), 415-32. (eds): Murrell, J. Collin; Kelly, Don P. Publisher: Intercept, Andover, UK). Similarly, various species of *Candida* will metabolize alanine or oleic acid (Sulter et al., Arch. Microbiol., 153: 485-489, 1990). Hence it is contemplated that the source of carbon utilized in the present invention can encompass a wide variety of carbon containing substrates and will only be limited by the choice of microorganism.

Although it is contemplated that all of the above mentioned carbon substrates and mixtures thereof are suitable in the present invention, in some embodiments, the carbon substrates are glucose, fructose, and sucrose, or mixtures of these with C5 sugars such as xylose and/or arabinose for yeasts cells modified to use C5 sugars. Sucrose can be derived from renewable sugar sources such as sugar cane, sugar beets, cassava, sweet sorghum, and mixtures thereof. Glucose and dextrose can be derived from renewable grain sources through saccharification of starch based feedstocks including grains such as corn, wheat, rye, barley, oats, and mixtures thereof. In addition, fermentable sugars can be derived from renewable cellulosic or lignocellulosic biomass through processes of pretreatment and saccharification, as described, for example, in U.S. Patent Appl. Pub. No. 2007/0031918 A1, which is herein incorporated by reference in its entirety. Biomass refers to any cellulosic or lignocellulosic material and includes materials comprising cellulose, and optionally further comprising hemicellulose, lignin, starch, oligosaccharides and/or monosaccharides. Biomass can also comprise additional components, such as protein and/or lipid. Biomass can be derived from a single source, or biomass can comprise a mixture derived from more than one source; for example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, fermentation media must contain suitable minerals, salts, cofactors, buffers and other components, known to those skilled in the art, suitable for growth of the cultures and promotion of the enzymatic pathway necessary for butanol production described herein.

Culture Conditions

Typically cells are grown at a temperature in the range of about 20° C. to about 40° C. in an appropriate medium. Suitable growth media in the present invention are common commercially prepared media such as Luria Bertani (LB) broth, Sabouraud Dextrose (SD) broth or Yeast Medium (YM) broth or broth that includes yeast nitrogen base, ammonium sulfate, and dextrose (as the carbon/energy source) or YPD Medium, a blend of peptone, yeast extract, and dextrose in optimal proportions for growing most *Saccharomyces carevisiae* strains. Other defined or synthetic growth media can also be used, and the appropriate medium for growth of the particular microorganism will be known by one skilled in the art of microbiology or fermentation science. The use of agents known to modulate catabolite repression directly or indirectly, e.g., cyclic adenosine 2',3'-monophosphate (cAMP), can also be incorporated into the fermentation medium.

Suitable pH ranges for the fermentation are between pH 5.0 to pH 9.0, where pH 6.0 to pH 8.0 is preferred for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are between about pH 3.0 to about pH 7.5. In one embodiment, about pH 4.5 to about pH 6.5 is used for the initial condition.

Fermentations can be performed under aerobic or anaerobic conditions. In one embodiment, anaerobic or microaerobic conditions are used for fermentation.

Industrial Batch and Continuous Fermentations

The present processes may employ a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired microorganism or microorganisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the medium. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples can be found in Thomas D. Brock in *Biotechnology: A Textbook of Industrial Microbiology*, Second Edition (1989) Sinauer Associates, Inc., Sunderland, Mass., or Deshpande, Mukund (Appl. Biochem. Biotechnol., 36: 227, 1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth.

Continuous fermentation allows for modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by medium turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing to the rate of product formation are well known in the art of industrial microbiology and a variety of methods are detailed by Brock, supra.

It is contemplated that the present invention can be practiced using either batch, fed-batch or continuous processes and that any known mode of fermentation would be suitable. Additionally, it is contemplated that cells can be immobilized on a substrate as whole cell catalysts and subjected to fermentation conditions for isobutanol production.

Methods for Butanol Isolation from the Fermentation Medium

Bioproduced butanol can be isolated from the fermentation medium using methods known in the art for ABE fermentations (see, e.g., Durre, *Appl. Microbial. Biotechnol.* 49:639-648 (1998), Groot et al., *Process. Biochem.* 27:61-75 (1992), and references therein). For example, solids can be removed from the fermentation medium by centrifugation, filtration, decantation, or the like. Then, the butanol can be isolated from the fermentation medium using methods such as distillation, azeotropic distillation, liquid-liquid extraction, adsorption, gas stripping, membrane evaporation, or pervaporation.

Because butanol forms a low boiling point, azeotropic mixture with water, distillation can be used to separate the mixture up to its azeotropic composition. Distillation can be used in combination with another separation method to obtain separation around the azeotrope. Methods that can be used in combination with distillation to isolate and purify butanol include, but are not limited to, decantation, liquid-liquid extraction, adsorption, and membrane-based techniques. Additionally, butanol can be isolated using azeotropic distillation using an entrainer (see, e.g., Doherty and Malone, *Conceptual Design of Distillation Systems*, McGraw Hill, N.Y., 2001).

The butanol-water mixture forms a heterogeneous azeotrope so that distillation can be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase can be returned to the first distillation column as reflux. The butanol-rich decanted organic phase can be further purified by distillation in a second distillation column.

The butanol can also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption can also be used to isolate butanol from the fermentation medium. In this method, the fermentation broth containing the butanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation can be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the ester can be formed by contacting the alcohol in a fermentation medium with a carboxylic acid (e.g., fatty acids) and a catalyst capable of esterfiying the alcohol with the carboxylic acid, as described in PCT Appn. Pub. No. WO/2011/159998 and U.S. Appl. Pub. No. 20120156738, which are herein incorporated by reference in their entireties. In such embodiments, the carboxylic acid can serve as an ISPR extractant into which the alcohol esters partition. The carboxylic acid can be supplied to the fermentation vessel and/or derived from the biomass supplying fermentable carbon fed to the fermentation vessel. Lipids present in the feedstock can be catalytically hydrolyzed to carboxylic acid, and the same catalyst (e.g., enzymes) can esterify the carboxylic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into carboxylic acid and substantially simultaneous esterification of the carboxylic acid with butanol present in the fermentation vessel. Carboxylic acid and/or native oil not derived from the feedstock can also be fed to the fermentation vessel, with the native oil being hydrolyzed into carboxylic acid. Any carboxylic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester may reduce the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to carboxylic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the carboxylic acid extractant can contact the fermentation medium at a time before the butanol concentration reaches a toxic level, so as to esterify the butanol with the carboxylic acid to produce butanol esters and consequently reduce the concentration of butanol in the fermentation vessel. The ester-containing organic phase can then be removed from the to fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially is complete.

EXAMPLES

Construction of Strains

TABLE 8

Strains referenced in the Examples

| Strain name | Genotype | Description |
|---|---|---|
| PNY2204 | MATa ura3Δ::loxP his3Δ pdc6Δ pdc1Δ::P[PDC1]-DHAD\|ilvD_Sm-PDC1t-pUC19-loxP-kanMX-loxP-P[FBA1]-ALS\|alsS_Bs-CYC1t pdc5Δ::P[PDC5]-ADH\|sadB_Ax-PDC5t gpd2Δ::loxP fra2Δ adh1Δ::UAS(PGK1)P[FBA1]-kivD_Ll(y)-ADH1t | PCT Publication No. WO2012033832, and U.S. Appl. Pub. No. US 20120237988A1, incorporated herein by reference in their entireties |
| PNY2211 | MATa ura3Δ::loxP his3Δ pdc6Δ pdc1Δ::P[PDC1]-DHAD\|ilvD_Sm-PDC1t-P[FBA1]-ALS\|alsS_Bs-CYC1t pdc5Δ::P[PDC5]-ADH\|sadB_Ax-PDC5t gpd2Δ::loxP fra2Δ adh1Δ::UAS(PGK1)P[FBA1]-kivD_Ll(y)-ADH1t | PCT Publication No. WO2012033832, and U.S. Appl. Pub. No. US 20120237988A1, incorporated herein by reference in their entireties |
| PNY2238 | MATa ura3Δ::loxP his3Δ pdc6Δ pdc1Δ::P[PDC1]-DHAD\|ilvD_Sm- | herein |

TABLE 8-continued

Strains referenced in the Examples

| Strain name | Genotype | Description |
|---|---|---|
| | PDC1t-P[FBA1]-ALS\|alsS_Bs-CYC1t pdc5Δ::P[PDC5]-ADH\|sadB_Ax-PDC5t gpd2Δ::loxP fra2Δ::P[PDC1]-ADH\|adh_Hl-ADH1t adh1Δ::UAS(PGK1)P[FBA1]-kivD_Ll(y)-ADH1t yprcΔ15Δ::P[PDC5]-ADH\|adh_Hl-ADH1t ymr226cΔ ald6Δ::loxP | |
| PNY2259 | MATa ura3Δ::loxP his3Δ pdc6Δ pdc1Δ::P[PDC1]-DHAD\|ilvD_Sm-PDC1t-P[FBA1]-ALS\|alsS_Bs-CYC1t pdc5Δ::P[PDC5]-ADH\|sadB_Ax-PDC5t gpd2Δ::loxP fra2Δ::P[PDC1]-ADH\|adh_Hl-ADH1t adh1Δ::UAS(PGK1)P[FBA1]-kivD_Lg(y)-ADH1t yprcΔ15Δ::P[PDC5]-ADH\|adh_Hl-ADH1t ymr226cΔ ald6Δ::loxP | herein |
| PNY1556 | MATa ura3Δ::loxP his3Δ pdc6Δ pdc1Δ::P[PDC1]-DHAD\|ilvD_Sm-PDC1t-P[FBA1]-ALS\|alsS_Bs-CYC1t pdc5Δ::P[PDC5]-ADH\|sadB_Ax-PDC5t gpd2Δ::loxP fra2Δ::P[PDC1]-ADH\|adh_Hl-ADH1t adh1Δ::UAS(PGK1)P[FBA1]-kivD_Lg(y)-ADH1t yprcΔ15Δ::P[PDC5]-ADH\|adh_Hl-ADH1t | herein |

Construction of PNY1528 (hADH Integrations in PNY2211)

Deletions/integrations were created by homologous recombination with PCR products containing regions of homology upstream and downstream of the target region and the URA3 gene for selection of transformants. The URA3 gene was removed by homologous recombination to create a scarless deletion/integration.

YPRCΔ15 Deletion and Horse Liver adh Integration

The YPRCΔ15 locus was deleted and replaced with the horse liver adh gene, codon optimized for expression in *Saccharomyces cerevisiae*, along with the PDC5 promoter region (538 bp) from *Saccharomyces cerevisiae* and the ADH1 terminator region (316 bp) from *Saccharomyces cerevisiae*. The scarless cassette for the YPRCΔ15 deletion-P[PDC5]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCA15 Fragment A was amplified from genomic DNA with primer oBP622 (SEQ ID NO: 269), containing a KpnI restriction site, and primer oBP623 (SEQ ID NO: 270), containing a 5' tail with homology to the 5' end of YPRCΔ15 Fragment B. YPRCΔ15 Fragment B was amplified from genomic DNA with primer oBP624 (SEQ ID NO: 271), containing a 5' tail with homology to the 3' end of YPRCΔ15 Fragment A, and primer oBP625 (SEQ ID NO: 272), containing a FseI restriction site. PCR products were purified with a PCR Purification kit (Qiagen). YPRCΔ15 Fragment A-YPRCΔ15 Fragment B was created by overlapping PCR by mixing the YPRCΔ15 Fragment A and YPRCΔ15 Fragment B PCR products and amplifying with primers oBPS22 (SEQ ID NO: 269) and oBP625 (SEQ ID NO: 272). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 273), containing a NofI restriction site, and primer oBP627 (SEQ ID NO: 274), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 275), containing an AscI restriction site, and primer HY24 (SEQ ID NO: 276), containing a 5' tail with homology to the 5' end of adh_HI(y). adh_HI(y)-ADH1t was amplified from pBP915 (SEQ ID NO: 279) with primers HY25 (SEQ ID NO: 277), containing a 5' tail with homology to the 3' end of P[PDC5], and HY4 (SEQ ID NO: 278), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 275) and HY4 (SEQ ID NO: 278).The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 269) and oBP627 (SEQ ID NO: 274).

Competent cells of PNY2211 were made and transformed with the YPRCΔ15 deletion-P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30° C. Transformants were screened for by PCR with primers URA3-end F (SEQ ID NO: 280) and oBP637 (SEQ ID NO: 283). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of YPRCΔ15 and integration of P[PDC5]-adh_HL(y)-ADH1t were confirmed by PCR with external primers oBP636 (SEQ ID NO: 281) and oBP637 (SEQ ID NO: 282) using genomic DNA prepared with a YeaStar Genomic DNA kit (Zymo Research). A correct isolate of the following genotype was selected for further modification: CEN.PK 113-7D MATa ura3Δ::loxP his3Δ pdc6Δ pdc1Δ::P[PDC1]-DHAD\|ilvD_Sm-PDC1t-P[FBA1]-ALS\|alsS_Bs-CYC1t pdc5Δ::P[PDC5]-ADH\|sadB_Ax-PDC5t gpd2Δ::loxP fra2Δ adh1Δ::UAS(PGK1)P[FBA1]-kivD_LI(y)-ADH1t yprcΔ15Δ:: P[PDC5]-ADH\|adh_HI-ADH1t.

Horse Liver Adh Integration at Fra2Δ

The horse liver adh gene, codon optimized for expression in *Saccharomyces cerevisiae*, along with the PDC1 promoter region (870 bp) from *Saccharomyces cerevisiae* and the ADH1 terminator region (316 bp) from *Saccharomyces cerevisiae*, was integrated into the site of the fra2 deletion. The scarless cassette for the fra2Δ-P[PDC1]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 287), containing a NotI restriction site, and primer oBP696 (SEQ ID NO: 288), containing a PacI restriction site. The fra2Δ Fragment C PCR product was digested with NotI and PacI and ligated with T4 DNA ligase into the corresponding sites of pUC19-URA3MCS. fra2Δ Fragment B was amplified from genomic DNA with primer oBP693 (SEQ ID NO: 285), containing a PmeI restriction site, and primer oBP694 (SEQ ID NO: 286), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 283), containing BamHI and AsiSI restriction sites, and primer oBP692 (SEQ ID NO: 284), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 289), containing an AscI restriction site, and primer HY19 (SEQ ID NO: 290), containing a 5' tail with homology to the 5' end of adh_HI(y). adh_HI(y)-ADH1t was amplified from pBP915 with primers HY20 (SEQ ID NO: 291), containing a 5' tail with homology to the 3' end of P[PDC1], and HY4 (SEQ ID NO: 278), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)-ADH1t PCR products and amplifying with primers HY16 (SEQ ID NO: 289) and HY4 (SEQ ID NO: 278). The resulting PCR product was digested with AscI and PmeI and ligated with T4 DNA ligase into the corresponding sites of the plasmid containing fra2Δ Fragments ABC. The entire integration cassette was amplified from the resulting plasmid with primers oBP691 (SEQ ID NO: 283) and oBP696 (SEQ ID NO: 288).

Competent cells of the PNY2211 variant with adh_HI(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30° C. Transformants were screened for by PCR with primers URA3-end F (SEQ ID NO: 280) and oBP731 (SEQ ID NO: 293). Correct transformants were grown in YPE (1% ethanol) and plated on synthetic complete medium supplemented with 1% EtOH and containing 5-fluoro-orotic acid (0.1%) at 30° C. to select for isolates that lost the URA3 marker. The integration of P[PDC1]-adh_HL(y)-ADH1t was confirmed by colony PCR with internal primer HY31 (SEQ ID NO: 294) and external primer oBP731 (SEQ ID NO: 293) and PCR with external primers oBP730 (SEQ ID NO: 292) and oBP731 (SEQ ID NO: 293) using genomic DNA prepared with a YeaStar Genomic DNA kit (Zymo Research). A correct isolate of the following genotype was designated PNY1528: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ:: P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_LI(y)-ADH1t yprcΔ15Δ::P[PDC5]-ADH|adh_HI-ADH1t.

PNY2237 (Scarless YMR226c Deletion)

The gene YMR226c was deleted from *S. cerevisiae* strain PNY1528 by homologous recombination using a PCR amplified 2.0 kb linear scarless deletion cassette. The cassette was constructed from spliced PCR amplified fragments comprised of the URA3 gene, along with its native promoter and terminator as a selectable marker, upstream and downstream homology sequences flanking the YMR226c gene chromosomal locus to promote integration of the deletion cassette and removal of the native intervening sequence and a repeat sequence to promote recombination and removal of the URA3 marker. Forward and reverse PCR primers (N1251 and N1252, SEQ ID NOs: 295 and 296, respectively), amplified a 1,208 bp URA3 expression cassette originating from pLA33 (pUC19::loxP-URA3-loxP (SEQ ID NO: 303)). Forward and reverse primers (N1253 and N1254, SEQ ID NOs: 297 and 298, respectively), amplified a 250 bp downstream homology sequence with a 3' URA3 overlap sequence tag from a genomic DNA preparation of *S. cerevisiae* strain PNY2211 (above). Forward and reverse PCR primers (N1255 and N1256, SEQ ID NOs: 299 and 300, respectively) amplified a 250 bp repeat sequence with a 5' URA3 overlap sequence tag from a genomic DNA preparation of *S. cerevisiae* strain PNY2211. Forward and reverse PCR primers (N1257 and N1258, SEQ ID NOs: 301 and 302, respectively) amplified a 250 bp upstream homology sequence with a 5' repeat overlap sequence tag from a genomic DNA preparation of *S. cerevisiae* strain PNY2211.

Approximately 1.5 μg of the PCR amplified cassette was transformed into strain PNY1528 (above) made competent using the ZYMO Research Frozen Yeast Transformation Kit and the transformation mix plated on SE 1.0%-uracil and incubated at 30° C. for selection of cells with an integrated ymr226cΔ::URA3 cassette. Transformants appearing after 72 to 96 hours are subsequently short-streaked on the same medium and incubated at 30° C. for 24 to 48 hours. The short-streaks are screened for ymr226cΔ::URA3 by PCR, with a 5' outward facing URA3 deletion cassette-specific internal primer (N1249, SEQ ID NO: 312) paired with a flanking inward facing chromosome-specific primer (N1239, SEQ ID NO: 310) and a 3' outward-facing URA3 deletion cassette-specific primer (N1250, SEQ ID NO: 313) paired with a flanking inward-facing chromosome-specific primer (N1242, SEQ ID NO: 311). A positive PNY1528 ymr226cΔ::URA3 PCR screen resulted in 5' and 3' PCR products of 598 and 726 bp, respectively.

Three positive PNY1528 ymr226cΔ::URA3 clones were picked and cultured overnight in a YPE 1% medium of which 100 μL was plated on YPE 1%+5-FOA for marker removal. Colonies appearing after 24 to 48 hours were PCR screened for marker loss with 5' and 3' chromosome-specific primers (N1239 and N1242). A positive PNY1528 ymr226cΔ markerless PCR screen resulted in a PCR product of 801 bp. Multiple clones were obtained and one was designated PNY2237.

PNY2238 and PNY2243 (ALD6 Deletion Strains)

A vector was designed to replace the ALD6 coding sequence with a Cre-lox recyclable URA3 selection marker. Sequences 5' and 3' of ALD6 were amplified by PCR (primer pairs N1179 and N1180 and N1181 and N1182, respectively; SEQ ID NOs: 304, 305, 306, and 307, respectively). After cloning these fragments into TOPO vectors (Invitrogen Cat. No. K2875-J10) and sequencing (M13 forward (SEQ ID NO:314) and reverse (SEQ ID NO:315) primers), the 5' and 3' flanks were cloned into pLA33 (pUC19::loxP::URA3::loxP) (SEQ ID NO:303) at the EcoRI and SphI sites, respectively. Each ligation reaction was transformed into *E. coli* Stbl3 cells, which were incubated on LB Amp plates to select for transformants. Proper insertion of sequences was confirmed by PCR (primers M13 forward (SEQ ID NO: 314) and N1180 (SEQ ID NO:306) and M13 reverse (SEQ ID NO:315) and N1181 (SEQ ID NO:306), respectively).

The vector described above (pUC19::ald6Δ::loxP-URA3-loxP) was linearized with AhdI and transformed into PNY1528 and PNY2237 using the standard lithium acetate method (except that incubation of cells with DNA was extended to 2.5 h). Transformants were obtained by plating on synthetic complete medium minus uracil that provided 1% ethanol as the carbon source. Patched transformants were screened by PCR to confirm the deletion/integration, using primers N1212 (SEQ ID NO: 308) and N1180 (5' end) (SEQ ID NO: 305) and N1181 (SEQ ID NO: 306) and N1213 (SEQ ID NO: 309) (3' end). A plasmid carrying Cre recombinase (pRS423::GAL1p-Cre=SEQ ID No. 324) was transformed into the strain using histidine marker selection. Transformants were passaged on YPE supplemented with 0.5% galactose. Colonies were screened for resistance to 5-FOA (loss of URA3 marker) and for histidine auxotrophy (loss of the Cre plasmid). Proper removal of the URA3 gene via the flanking loxP sites was confirmed by PCR (primers N1262 and N1263, SEQ ID NOs: 316 and 317, respectively). Additionally, primers internal to the ALD6 gene (N1230 and N1231; SEQ ID NOs: 322 and 323, respectively) were used to insure that no merodiploids were present. Finally, ald6Δ::loxP clones were screened by PCR to confirm that a translocation between ura3Δ:loxP (N1228 and N1229, SEQ ID NOs: 320 and 321) and gpd2Δ::loxP (N1223 and N1225, SEQ ID NOs: 318 and 319) had not occurred. Two positive clones were identified from screening of transformants of PNY1528. Clone B has been designated PNY2243. Three positive clones were identified from screening transformants of PNY2237. Clones E and K were both assessed for isobutanol production at small scale (below). Although statistically identical in most parameters, Clone E was selected (PNY2238) for further development.

Construction of Strain PNY2259

The purpose of this example is to describe the assembly of the constructs used to replace the chromosomal copy of kivD_LI(y) in PNY2238 at the adh1Δ locus with kivD_Lg(y).

The deletion/integration was created by homologous recombination with PCR products containing regions of homology upstream and downstream of the target region and the URA3 gene for selection of transformants. The URA3 gene was removed by homologous recombination to create a scarless deletion/integration. The plasmid to integrate kivD_Lg(y) was derived from a plasmid constructed to integrate UAS(PGK1)P[FBA1]-kivD_LI(y) into the ADH1 locus of Saccharomyces cerevisiae. Construction of the plasmid used to integrate UAS(PGK1)P[FBA1]-kivD_LI(y) into the ADH1 locus is described below. The plasmids were constructed in pUC19-URA3MCS.

Construction of the ADH1 Deletion/UAS(PGK1)P[FBA1]-kivD_LI(y), Integration Plasmid The kivD coding region from Lactococcus lactis codon optimized for expression in Saccharomyces cerevisiae, kivD_LI(y), was amplified using pLH468 (SEQ ID NO: 335) as template with primer oBP562 (SEQ ID NO: 325), containing a PmeI restriction site, and primer oBP563 (SEQ ID NO: 326), containing a 5' tail with homology to the 5' end of ADH1 Fragment B. ADH1 Fragment B was amplified from Saccharomyces cerevisiae CEN.PK 113-7D genomic DNA with primer oBP564 (SEQ ID NO: 327), containing a 5' tail with homology to the 3' end of kivD_LI(y), and primer oBP565 (SEQ ID NO: 328), containing a FseI restriction site. PCR products were purified with a PCR Purification kit (Qiagen; Valencia, Calif.). kivD_LI(y)-ADH1 Fragment B was created by overlapping PCR by mixing the kivD_LI(y) and ADH1 Fragment B PCR products and amplifying with primers oBP562 (SEQ ID NO: 325) and oBP565 (SEQ ID NO: 328). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 329), containing a SacI restriction site, and primer oBP506 (SEQ ID NO: 330), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO: 331), containing a PacI restriction site, and primer oBP508 (SEQ ID NO: 332), containing a SalI restriction site. The ADH1 Fragment C PCR product was digested with PacI and SalI and ligated with T4 DNA ligase into the corresponding sites of the plasmid containing ADH1 Fragment A-kivD_LI(y)-ADH1 Fragment B. The hybrid promoter UAS(PGK1)-$P_{FBA1}$ (SEQ ID NO: 264) was amplified from vector pRS316-UAS(PGK1)-$P_{FBA1}$-GUS with primer oBP674 (SEQ ID NO: 333), containing an AscI restriction site, and primer oBP675 (SEQ ID NO: 334), containing a PmeI restriction site. The UAS(PGK1)-$P_{FBA1}$ PCR product was digested with AscI and PmeI and ligated with T4 DNA ligase into the corresponding sites of the plasmid containing kivD_LI(y)-ADH1 Fragments ABC to generate pBP1181.

Construction of pBP1716 and pBP1719 kivD_LI(y) was removed from the ADH1 deletion/UAS (PGK1)P[FBA1]-kivD_LI(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 336), containing a PmeI restriction site, and primer oBP484 (SEQ ID NO: 337), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_LI(y) was cloned into the resulting vector for the targeted deletion of kivD_LI(y) in PNY1528. The fragment was amplified from pBP1181 with primers oBP822 (SEQ ID NO: 338), containing a NotI restriction site, and oBP823 (SEQ ID NO: 339), containing a PacI restriction site. The fragment was digested with NotI and PacI and ligated with T4 DNA ligase into the corresponding sites downstream of URA3 in the above plasmid with the kivD_LI(y) deletion after digestion with the appropriate restriction enzymes. The resulting plasmid was designated pBP1716.

The kivD coding region from Listeria grayi codon optimized for expression in Saccharomyces cerevisiae (SEQ ID NO: 340), kivD_Lg(y), was synthesized by DNA2.0 (Menlo Park, Calif.). kivD_Lg(y) was amplified with primers oBP828 (SEQ ID NO: 341), containing a PmeI restriction site, and oBP829 (SEQ ID NO: 342) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 343) and oBP829 (SEQ ID NO: 342). An isolate with kivD_Lg(y) in the correct orientation was designated pBP1719.

Construction of Strain PNY2259

The kivD_μg(y) deletion/kivD_Lg(y) integration cassette was amplified from pBP1719 with primers oBP505 (SEQ ID NO: 329) and oBP823 (SEQ ID NO: 339). Competent cells of the PNY2238 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30C. Transformant strains were screened by PCR (JumpStart™ REDTaq (c) ReadyMix™)

using primers Ura3-end F (SEQ ID NO: 280) and HY-50 (SEQ ID NO: 344). Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_LI(y) and integration of kivD_Lg(y) was confirmed by PCR with primers HY-50 and oBP834 (SEQ ID NO: 345). One correct isolate contained kivD_Lg(y) at the same locus and expressed from the same promoter as kivD_LI(y) in PNY2238 was designated PNY2259.

Construction of Strain PNY1556

Described here is the assembly of the constructs used to replace the chromosomal copy of kivD_LI(y) in PNY1528 at the adh1Δ locus with kivD_Lg(y) and construction of strain PNY1556 expressing the kivD_Lg(y) gene. Deletions/integrations were created by homologous recombination with PCR products containing regions of homology upstream and downstream of the target region and the URA3 gene for selection of transformants as described in the previous section. The plasmid to integrate kivD_Lg(y) was derived from a plasmid constructed to integrate UAS(PGK1)P[FBA1]-kivD_LI(y) into the ADH1 locus of Saccaromyces cerevisiae. Construction of the plasmid used to integrate UAS(PGK1)P [FBA1]-kivD_LI(y) into the ADH1 locus is described below. The plasmids were constructed in pUC19-URA3MCS.

Construction of the ADH1 deletion/UAS(PGK1)P [FBA1]-kivD_LI(y) Integration Plasmid The kivD coding region from Lactococcus lactis codon optimized for expression in Saccharomyces cerevisiae, kivD_LI(y), was amplified using pLH468 (SEQ ID NO: 129) as template with primer oBP562 (SEQ ID NO: 384), containing a PmeI restriction site, and primer oBP563 (SEQ ID NO: 385), containing a 5' tail with homology to the 5' end of ADH1 Fragment B. ADH1 Fragment B was amplified from Saccharomyces cerevisiae CEN.PK 113-7D genomic DNA with primer oBP564 (SEQ ID NO: 386), containing a 5' tail with homology to the 3' end of kivD Ll(y), and primer oBP565 (SEQ ID NO: 387), containing a FseI restriction site. PCR products were purified with a PCR Purification kit (Qiagen; Valencia, Calif.). kivD_LI(y)-ADH1 Fragment B was created by overlapping PCR by mixing the kivD_LI(y) and ADH1 Fragment B PCR products and amplifying with primers oBP562 (SEQ ID NO: 384) and oBP565 (SEQ ID NO 387). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 329), containing a SacI restriction site, and primer oBP506 (SEQ ID NO: 330), containing an AscI restriction site. The ADH1 Fragment A PCR product was digested with SacI and AscI and ligated with T4 DNA ligase into the corresponding sites of the plasmid containing kivD_LI(y)-ADH1 Fragment B. ADH1 Fragment C was amplified from genomic DNA with primer oBP507 (SEQ ID NO: 331), containing a Jo Pad restriction site, and primer oBP508 (SEQ ID NO: 332), containing a SalI restriction site. The ADH1 Fragment C PCR product was digested with Pad and SalI and ligated with T4 DNA ligase into the corresponding sites of the plasmid containing ADH1 Fragment A-kivD_LI(y)-ADH1 Fragment B. The hybrid promoter UAS(PGK1)-$P_{FBA1}$ was amplified from vector pRS316-UAS(PGK1)-PFBA1-GUS (SEQ ID NO: 389) with primer oBP674 (SEQ ID NO: 333), containing an AscI restriction site, and primer oBP675 (SEQ ID NO: 334), containing a PmeI restriction site. The UAS(PGK1)-$P_{FBA1}$ PCR product was digested with AscI and PmeI and ligated with T4 DNA ligase into the corresponding sites of the plasmid containing kivD_LI(y)-ADH1 Fragments ABC to generate pBP1181.

kivD_LI(y) was removed from the ADH1 deletion/UAS (PGK1)P[FBA1]-kivD_LI(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 336), containing a PmeI restriction site, and primer oBP484 (SEQ ID NO: 337), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_LI(y) was cloned into the resulting vector for the targeted deletion of kivD_LI(y) in PNY1528. The fragment was amplified from pBP1181 with primers oBP822 (SEQ ID NO: 338), containing a NotI restriction site, and oBP823 (SEQ ID NO: 339), containing a PacI restriction site. The fragment was digested with NotI and PacI and ligated with T4 DNA ligase into the corresponding sites downstream of URA3 in the above plasmid with the kivD_LI(y) deletion after digestion with the appropriate restriction enzymes. The resulting plasmid was designated pBP1716.

The kivD coding region from Listeria grayi codon optimized for expression in Saccharomyces cerevisiae (SEQ ID NO: 390), kivD_Lg(y), was synthesized by DNA2.0 (Menlo Park, Calif.). kivD_Lg(y) was amplified with primers oBP828 (SEQ ID NO: 341), containing a PmeI restriction site, and oBP829 (SEQ ID NO: 342) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 343) and oBP829 (SEQ ID NO: 342). An isolate with kivD_Lg(y) in the correct orientation was designated pBP1719.

The kivD_LI(y) deletion/kivD_Lg(y) integration cassette was amplified from pBP1719 with primers oBP505 (SEQ ID NO: 329) and oBP823 (SEQ ID NO: 339). Competent cells of the PNY1528 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30C. Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_LI(y) and integration of kivD_Lg(y) was confirmed by PCR with primers oBP674 (SEQ ID NO: 333) and oBP830 (SEQ ID NO: 391) using genomic DNA prepared with a YeaStar Genomic DNA kit (Zymo Research). A correct isolate contained kivD_Lg(y) at the same locus and expressed from the same promoter as kivD_LI(y) in PNY1528 and was designated PNY1556.

General Methods for Examples 1-4

Yeast Transformation with Plasmids:

Frozen aliquots of competent cells of yeast strains to be transformed with KARI-containing plasmids were made as follows. For cases where the KARI and DHAD genes were on separate plasmids, competent cells were first made from cells harboring the DHAD-containing plasmid (e.g. pBP915). Those competent cells were then transformed with the KARI-containing plasmids.

10 mL of growth medium (YPE for plasmid-free yeast, SE -His for yeast harboring a DHAD-containing plasmid such as pBP915) was inoculated with a loop of cells from a freshly patched plate. The culture was shaken overnight at 30° C. The $OD_{600\ nm}$ of the overnight culture was measured with a cuvette spectrophotometer and a calculated amount of cells was used to inoculate a subsequent 30 mL culture at an initial $OD_{600\ nm}$ of 0.2. The growth medium was YPE for plasmid-free yeast or SE -His for yeast harboring a DHAD-containing plasmid such as pBP915. The flask containing the 30 mL culture was shaken for approximately 8 hours at 30° C. until the $OD_{600\ nm}$ reached approximately 0.7 to 1.0. 25 mL of the culture was centrifuged at 4000 rpm for 10 minutes in a swinging-bucket rotor. The supernatant was discarded and the pellet was resuspended in 10 mL of EZ 1 solution (from the Frozen-EZ Yeast Transformation II Kit, Catalog #T2001, Zymo Research, Orange, Calif.). The cells were recentrifuged as above and the supernatant was discarded. The pellet was resuspended 1.75 mL EZ 2 solution (Zymo Research) and aliquoted into microfuge tubes for freezing. The aliquots of competent cells were placed inside two concentric styrofoam boxes to prolong the freezing process. The assembly was placed in a freezer at −80° C. The aliquots were transferred out of the concentric styrofoam boxes into standard freezer boxes after no less than 12 hours.

Yeast cells were transformed with plasmids as follows: For each plasmid to be transformed, 8 µL (300-400 ng) of plasmid DNA solution was dispensed into a 1.5 mL microfuge tube. Aliquots of frozen competent yeast cells were thawed on ice. 20 µL of thawed competent yeast cells was added to each tube and mixed with the DNA by pipette. 200 µL of EZ 3 Solution (Zymo Research) was added to each tube and mixed by pipetting. The mixtures were incubated at 30° C. for approximately 2 hours with intermittent vortex mixing every 30-45 minutes. 150 µL of each transformation mixture was spread onto SE -Ura or SE -Ura -His plates (as appropriate to the plasmid(s) in the experiment). The plates were sealed in zip-top plastic bags and incubated at 30° C. until colonies appeared.

Yeast Cultivation Conditions

Aerobic cultivation medium: SE -Ura medium (or SE -Ura -His for 2-plasmid system experiments) with 2 g/l ethanol.

Anaerobic cultivation medium: SEG -Ura (or SEG -Ura -His for 2-plasmid system experiments) with 30 g/l glucose and 1 g/l ethanol, supplemented with 10 mg/l ergosterol, 50 mM MES buffer (pH 5.5), 30 mg/l thiamine, and 30 mg/l nicotinic acid.

48-well plates: Axygen catalog #P-5ML-48-C—S, 5 ml/well total volume, culture volume of 1.5 ml/well.

Plates were covered with a permeable adhesive film for aerobic cultivation. Plates were shaken at 225 rpm at 30° C. For anaerobic cultivation, freshly inoculated plates covered with permeable film were purged of oxygen by equilibration in an anaerobic chamber for 2 hours. The plate covers were then exchanged for adhesive aluminum covers and each plate was placed into an airtight plastic box along with a fresh oxygen scavenger pack. The entire assembly (plate(s) and oxygen scavenger pack inside a sealed airtight plastic box) was removed from the anaerobic chamber and shaken at 225 rpm at 30° C.

Experimental Protocol

Single yeast colonies on SE -Ura or SE -Ura -His agar plates (as appropriate for the plasmid(s) in the strains used) were streaked onto fresh agar plates of the same type and incubated at 30° C. until dense patches of cells had grown. Liquid precultures in 48-well plates were inoculated with loops of these cells for initial aerobic cultivation. After shaking overnight, the OD600 of each culture well was measured by transferring 0.15 ml of each well into a flat-bottom 96-well plate and measuring the absorbance of each well at 600 nm with a Molecular Devices plate reader. A linear transformation based on an experimentally-determined calibration line was applied to these plate reader-measured optical densities to convert them into comparable absorbance values for a cuvette-based spectrophotometer.

A calculated portion of each aerobic preculture well was inoculated into the corresponding well of a fresh 48-well plate with 1.5 ml of the anaerobic cultivation medium, to achieve an initial OD600 (in cuvette spectrophotometer absorbance units) of 0.2. In the process of inoculating the fresh plate, the aerobic preculture plate was centrifuged, the supernatant was removed from each well, and the cells in each well were resuspended in fresh anaerobic cultivation medium, in order to minimize carryover of metabolites from one cultivation to the next. This anaerobic cultivation plate was shaken for 2-3 days, depending on the experiment. The isobutanol concentration in the culture supernatants was measured by HPLC (either with a mass spectrometric detector or a refractive-index detector).

A follow-up anaerobic cultivation ("Passaging Cycle #2") was initiated from the first anaerobic cultivation as follows: A calculated portion of each anaerobic culture well was inoculated into the corresponding well of a fresh 48-well plate with 1.5 ml of the anaerobic cultivation medium, to achieve an initial OD600 (in cuvette spectrophotometer units) of 0.2. In the process of inoculating the fresh plate, the growth plate was centrifuged, the supernatant was removed from each well, and the cells in each well were resuspended in fresh anaerobic cultivation medium, in order to minimize carryover of metabolites from one passaging cycle to the next. The follow-up (second-cycle) anaerobic cultivation plate was shaken for 2-3 days, depending on the experiment. The isobutanol concentration in the culture supernatants was measured by HPLC as above.

Strain and Growth Medium Details were as follows for Examples 1-5:

Example 1: PNY2204 transformed with two plasmids: 1) a KARI variant plasmid based on SEQ ID NO: 162 and 2) the plasmid given as SEQ ID NO: 163 for expression of *S. mutans* DHAD and growth media lacking uracil and histidine.

Example 2: PNY2238 transformed with two plasmids (SEQ ID NO: 163 and a KARI-variant plasmid based on SEQ ID NO: 162), growth media lacking uracil and histidine.

Example 3: PNY2238 transformed with two plasmids (SEQ ID NO: 163 and a KARI-variant plasmid based on SEQ ID NO: 162 as in Example 1), growth media lacking uracil and histidine.

Example 4: PNY2259 transformed with a single plasmid, growth media lacking uracil.

Example 5: PNY1556 transformed with a single plasmid, growth media lacking uracil.

Figure 7:
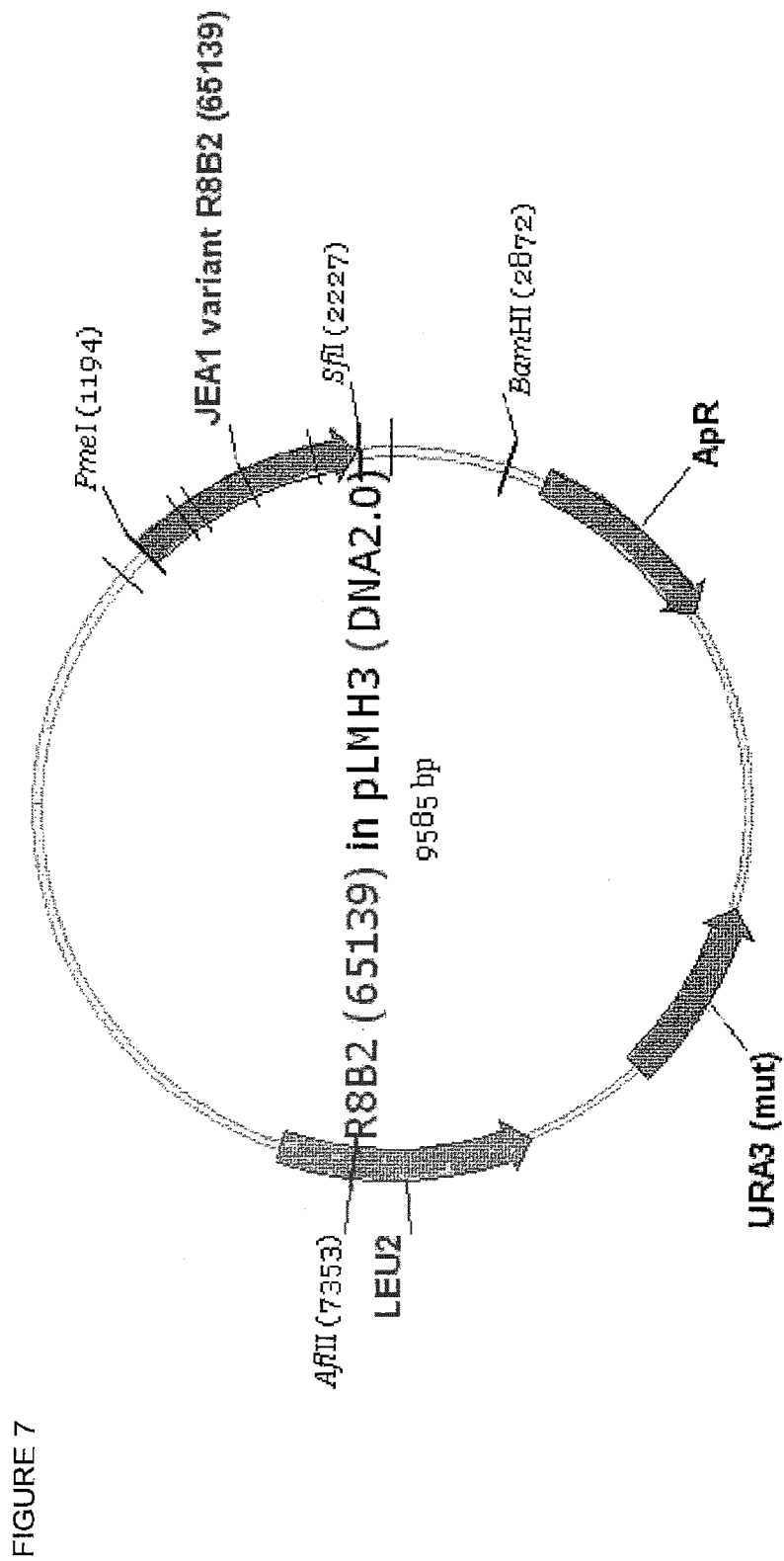
FIG. 7 is a plasmid map of an example of the vector (SEQ ID NO: 347; containing the coding sequence for KARI variant 65139) used in combination with the plasmid given as SEQ ID NO: 163 in the Examples where indicated. This plasmid is similar to the plasmid depicted in FIG. 3, but the Ura3 gene has been modified with a silent mutation to eliminate the BsmBI site within.

To generate the KARI-variant plasmid for strains transformed with two plasmids (above), coding sequences for KARI variants were generated by DNA 2.0 (Menlo Park, Calif.) and were subcloned into a modified vector based on SEQ ID NO: 162. An example resultant KARI-variant plasmid (containing the coding sequence for KARI variant 65139; FIG. 7) is given as SEQ ID NO: 347. Such KARI variant plasmids were used in combination with the plasmid given as SEQ ID NO: 163 as described above.

Figure 3:
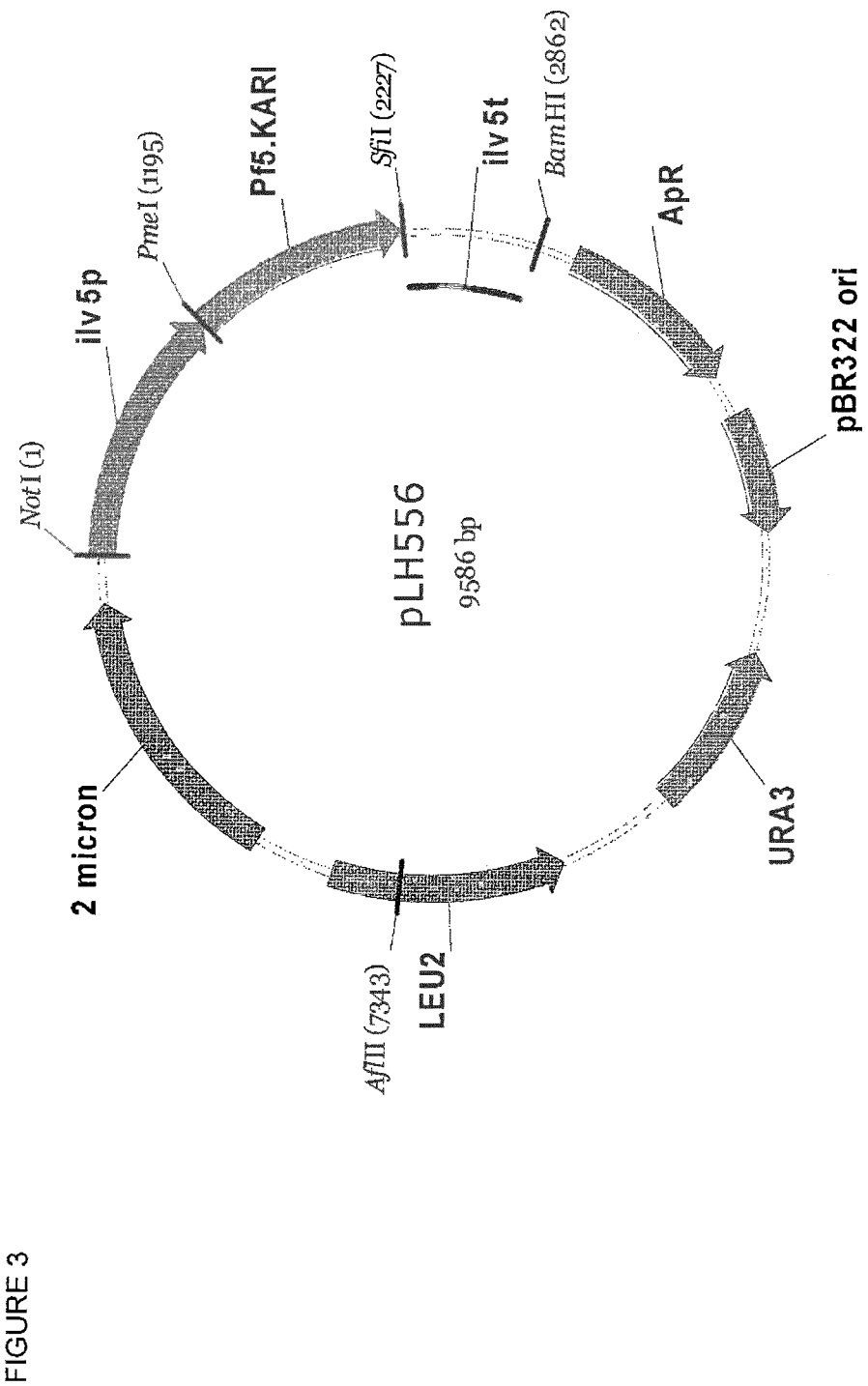
FIG. 3 is a plasmid map of pLH556 (pHR81-PIlv5-Pf5.KARI) (SEQ ID NO: 162). Plasmid pLH556 contains a 2-micron origin of replication for yeast, a pBR322 origin for *E. coli*, Leu2 and Ura3 auxotrophic marker genes for maintenance in yeast, an ampicillin resistance marker gene for maintenance in *E. coli*, and a KARI open reading frame cloned between PmeI and SfiI restriction sites. The KARI promoter is ilv5p and the KARI terminator is ilv5t.
Figure 4:
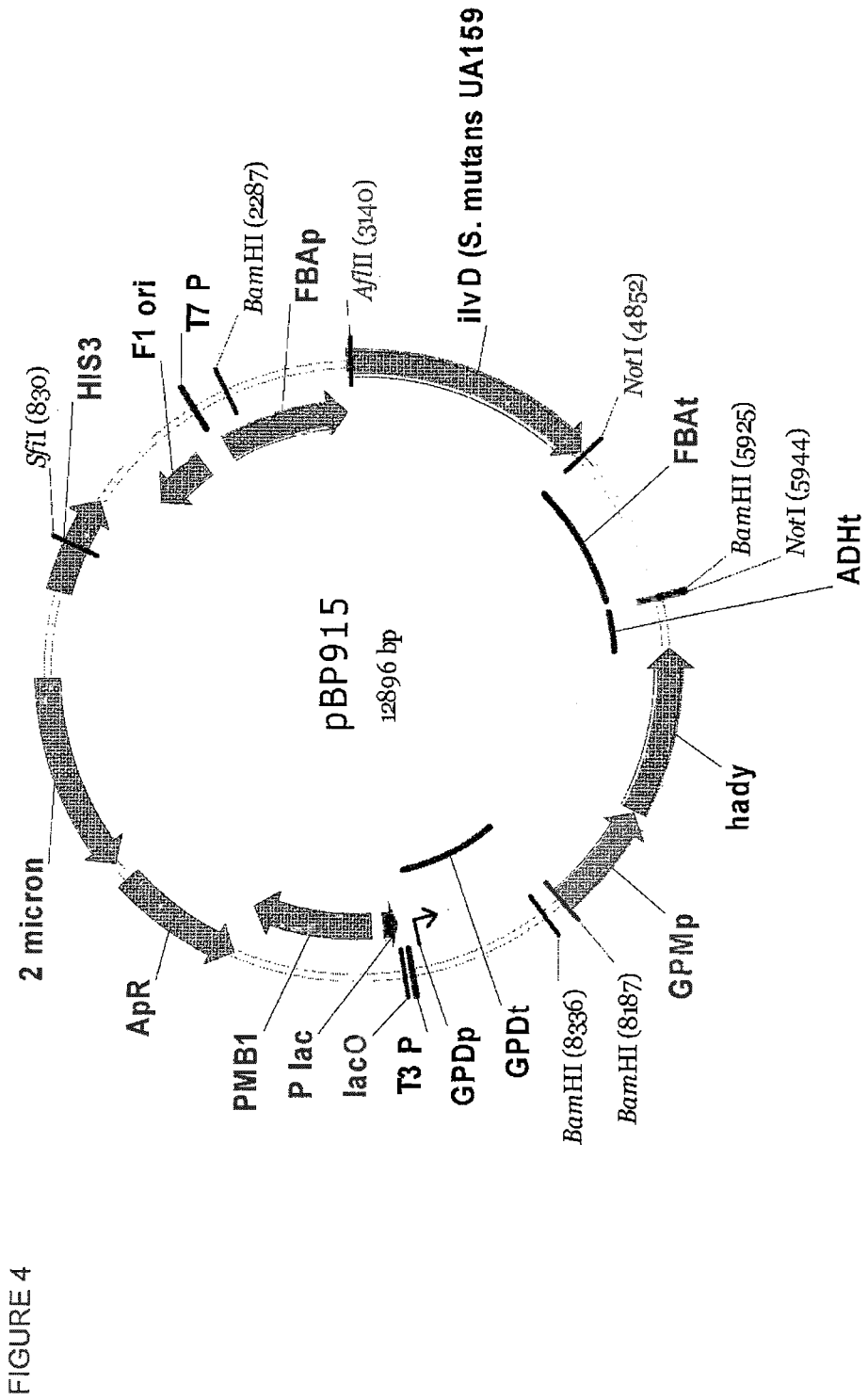
FIG. 4 is a plasmid map of pBP915 (SEQ ID NO: 163). Plasmid pBP915 contains a 2-micron origin of replication for yeast, a pMB1 origin for *E. coli*, and an F1 origin for phage F1. It contains a His3 auxotrophic marker gene for maintenance in yeast, and an ampicillin resistance marker gene for maintenance in *E. coli*. The IlvD (DHAD) gene from *S. mutans* strain UA159 is cloned between AflII and NotI restriction sites. The ilvD promoter is FBAp and the ilvD terminator is FBAt. The horse alcohol dehydrogenase gene is also present, with a GPMp promoter and ADHt terminator.
Figure 5:
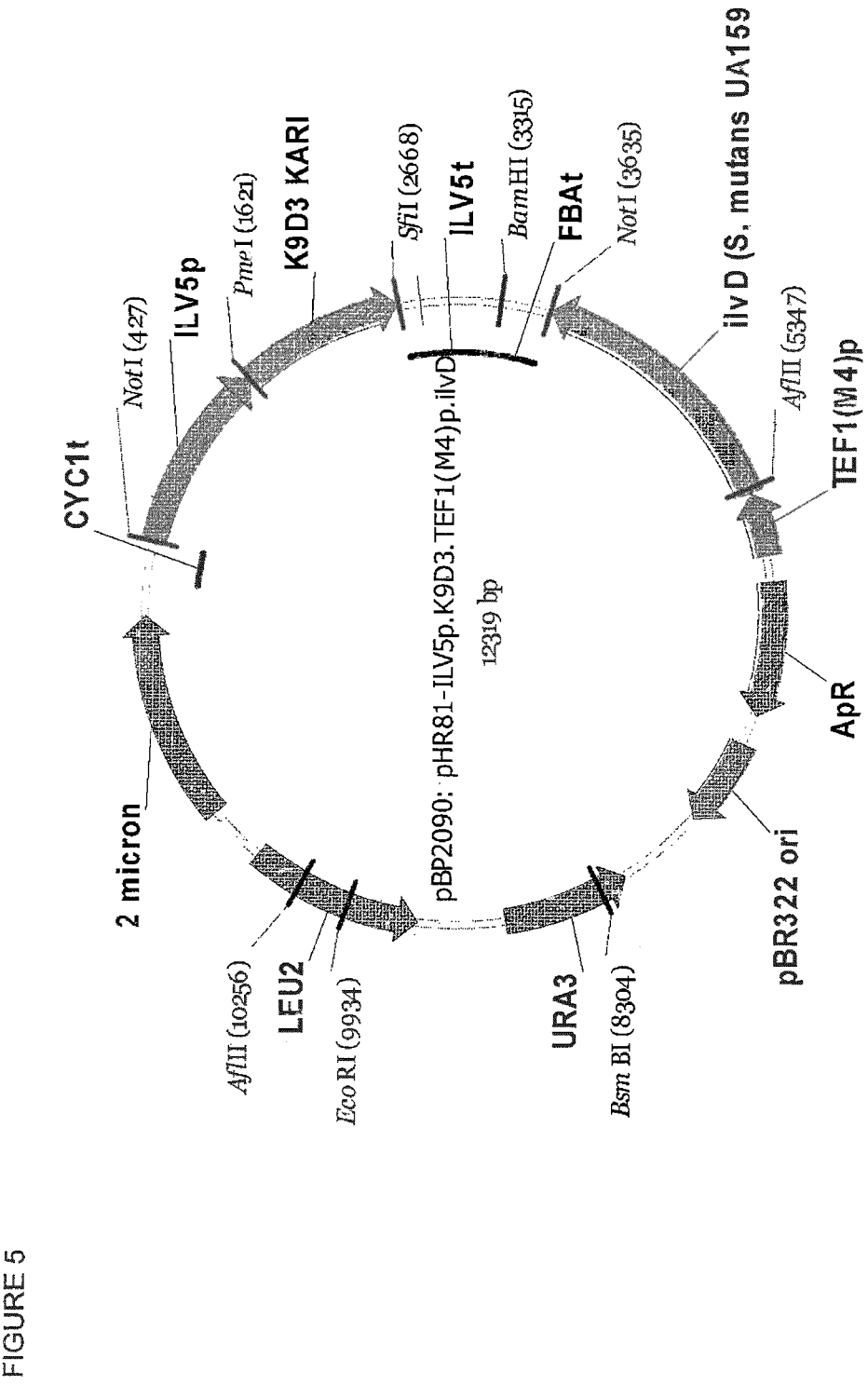
FIG. 5 is a plasmid map of pBP2090 (pHR81-PIIv5p.K9D3.TEF1(M4)p.ilvD) vector (SEQ ID NO: 164). Plasmid pBP2090 contains a 2-micron origin of replication for yeast, a pBR322 origin for *E. coli*, Leu2 and Ura3 auxotrophic marker genes for maintenance in yeast, an ampicillin resistance marker gene for maintenance in *E. coli*, and a KARI ORF cloned between PmeI and SfiI restriction sites. The KARI promoter is ilv5p and the KARI terminator is ilv5t. The plasmid also contains the IlvD (DHAD) gene from *S. mutans* strain UA159 cloned between AflIII and NotI restriction sites. The ilvD promoter is a modified TEF1 promoter (TEF1(M4)p) and the ilvD terminator is FBAt.
Figure 6:
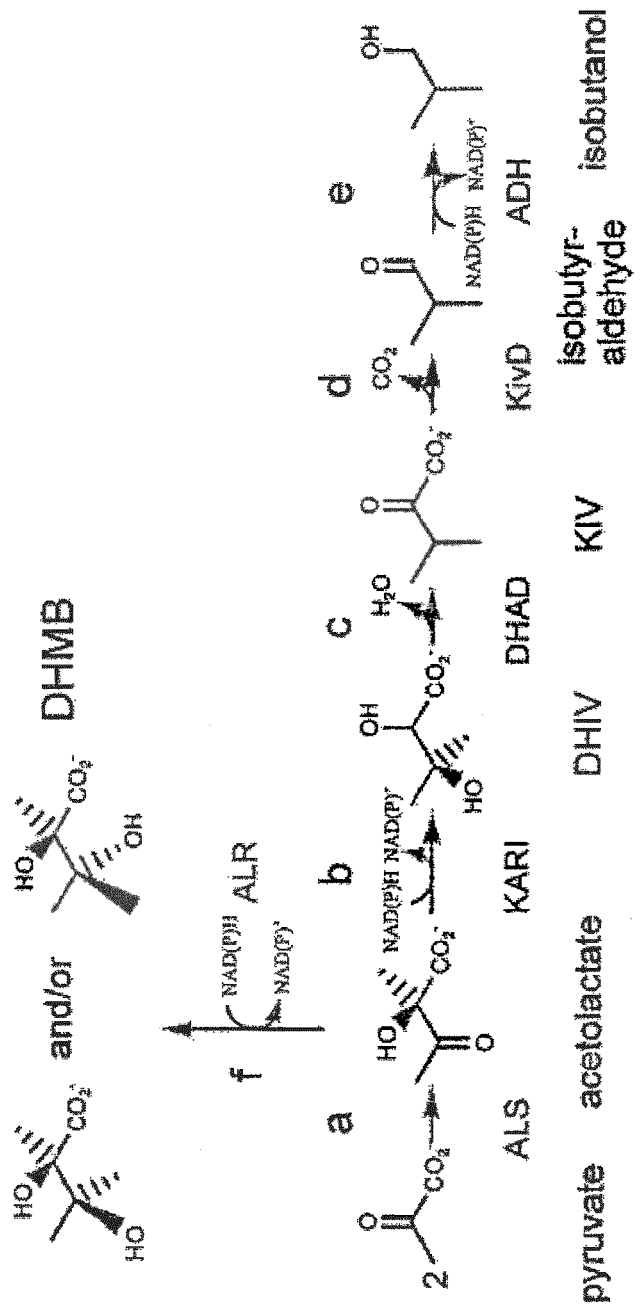
FIG. 6 shows an isobutanol biosynthetic pathway. Step "a" represents the conversion of pyruvate to acetolactate. Step "b" represents the conversion of acetolactate to DHIV. Step "c" represents the conversion of dihydroxyisovalerate (DHIV) to ketoisovalerate (KIV). Step "d" represents the conversion of KIV to isobutyraldehyde. Step "e" represents the conversion of isobutyraldehyde to isobutanol. Step "f" represents the conversion of acetolactate to 2,3-dihydroxy-2-methylbutyrate (DHMB).

To generate the single plasmid, coding sequences for KARI variants were generated by DNA 2.0 (Menlo Park, Calif.) and were subcloned into a modified "single-plasmid vector" (SEQ ID NO: 162, FIG. 3; modified plasmid sequence given as SEQ ID NO: 348), replacing the K9D3

Figure 8:
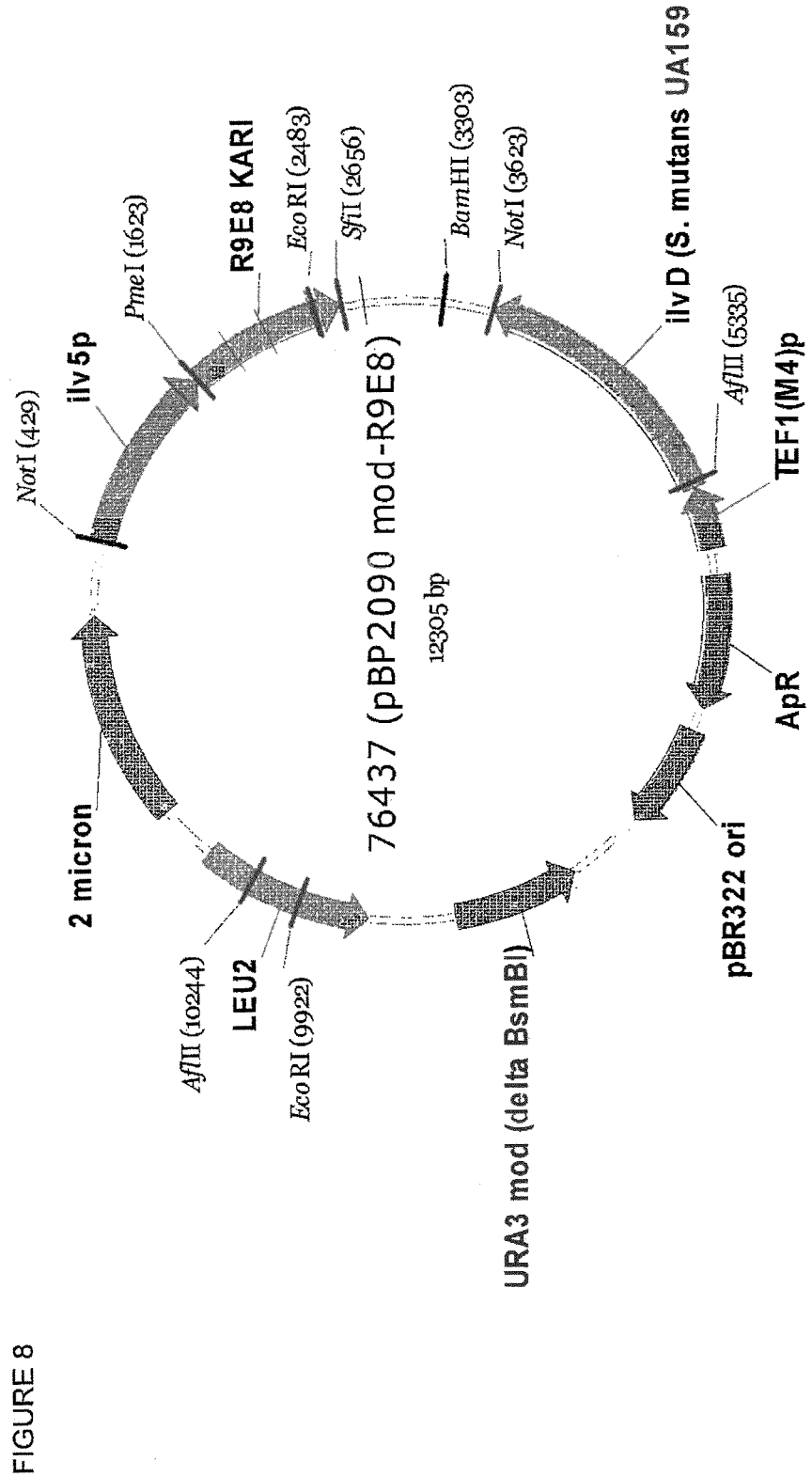
FIG. 8 is a plasmid map of an example of the vector (SEQ ID NO: 349; containing the coding sequence for KARI variant 76437 "R9E8") used in the Examples where indicated. This plasmid is similar to the plasmid depicted in FIG. 5, but the Ura3 gene has been modified with a silent mutation to eliminate the BsmBI site within.
Figure 9:
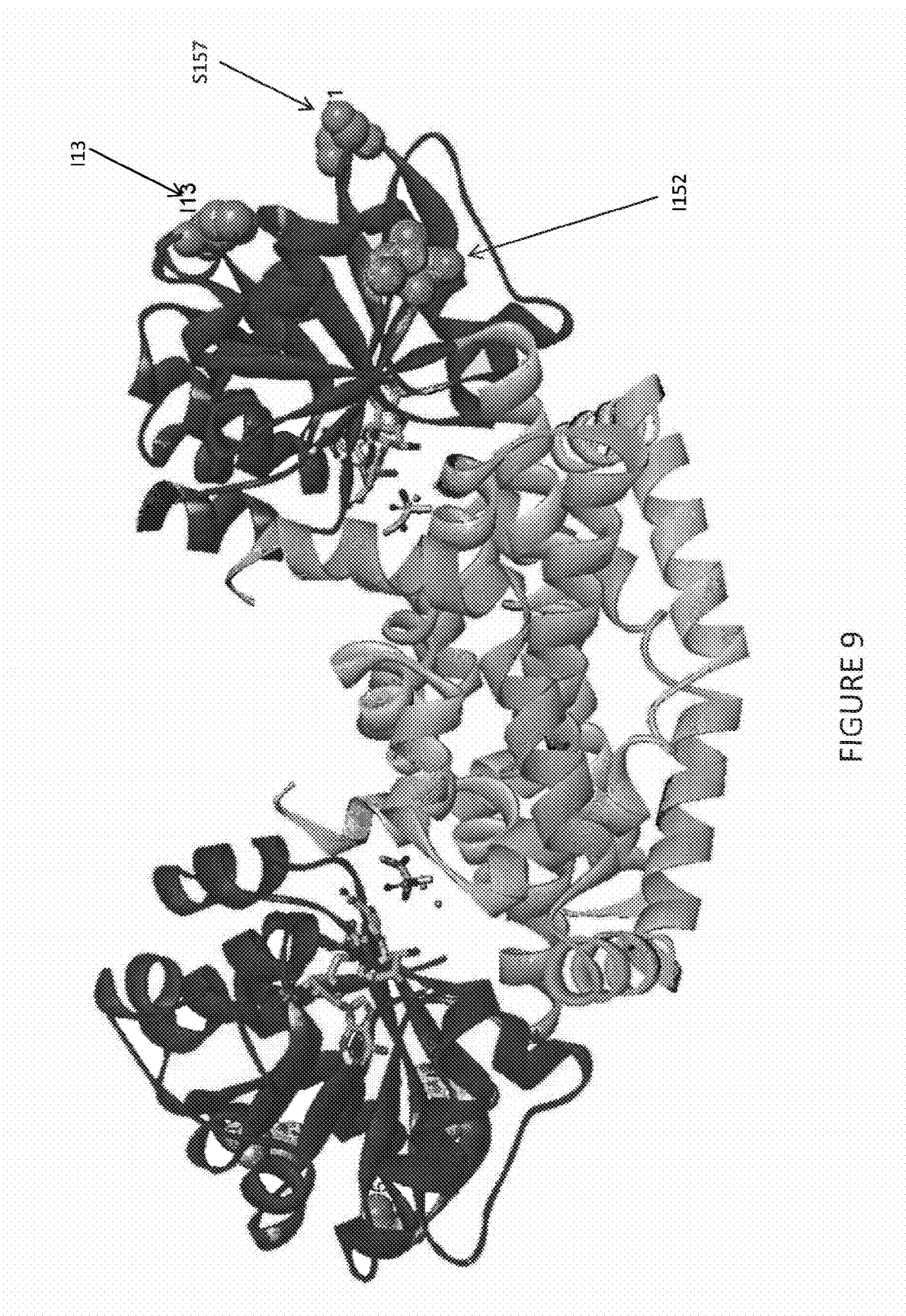
FIG. 9 shows the homology model of Pf5 KARI dimer. Positions I13, I152 and S157 are indicated (arrows) in one of the monomers.

KARI coding region. An example of a resulting plasmid (for expression of KARI variant SEQ ID NO: 159, "76437" and also known as "R9E8") is given as SEQ ID NO: 349, FIG. 8.

Example 1

Variants Generated and Tested in an Isobutanol Production Pathway

TABLE 9

KARI Variants

| SEQ ID NO: | Variant Identifier | Amino Acid Substitutions (relative to JEA1) | | | | |
|---|---|---|---|---|---|---|
| 3 | 54654 | P47F | S292A | S322A | | |
| 4 | 54655 | I13L | Y286F | I291V | | |
| 5 | 54656 | P47F | V76I | A336R | | |
| 6 | 54657 | Y286F | I291V | A336R | | |
| 7 | 54658 | P47F | I291V | A336G | | |
| 8 | 54659 | L88V | Y286F | A336R | | |
| 9 | 54660 | V76I | I152V | A336G | | |
| 10 | 54661 | I13L | V53A | I291V | | |
| 11 | 54662 | I152V | Y286F | S322A | | |
| 12 | 54663 | V76I | A268E | S292A | | |
| 13 | 54664 | A268E | Y286F | S322A | A336G | |
| 14 | 54665 | Y286F | I291V | S292A | S322A | |
| 15 | 54666 | I13L | S292A | S322A | A336R | |
| 16 | 54667 | V76I | I152V | I291V | A336R | |
| 17 | 54668 | I13L | I152V | I291V | A336R | |
| 18 | 54669 | V76I | S292A | S322A | A336R | |
| 19 | 54670 | P47F | V76I | I291V | A336R | |
| 20 | 54671 | V76I | Y286F | S322A | A336R | |
| 21 | 54672 | P47F | Y286F | I291V | A336R | |
| 22 | 54673 | V76I | L88V | S322A | A336R | |
| 23 | 54674 | V76I | L88V | S292A | S322A | A336G |
| 24 | 54675 | V76I | Y286F | I291V | S322A | A336R |
| 25 | 54676 | V53A | A268E | Y286F | I291V | A336R |
| 26 | 54677 | V76I | I152V | Y286F | S322A | A336G |
| 27 | 54678 | I13L | L88V | Y286F | I291V | S292A |
| 28 | 54679 | I13L | A268E | Y286F | I291V | A336G |
| 29 | 54680 | I13L | V76I | I152V | S292A | A336R |
| 30 | 54681 | I13L | P47F | V53A | V76I | I152V |
| 31 | 54682 | P47F | V76I | Y286F | I291V | A336G |
| 32 | 54683 | P47F | V53A | I152V | S322A | A336G |
| 2 | 54684 (JEA1) | — | — | — | — | — |

TABLE 10

Measured Isobutanol Titers (from PNY2204, anaerobic passage #2)

| Variant identifier | Isobutanol Titer (mM) |
|---|---|
| 54654 | 5 |
| 54654 | 1 |
| 54654 | 7 |
| 54655 | 50 |
| 54655 | 52 |
| 54655 | 57 |
| 54656 | 1 |
| 54656 | 2 |
| 54656 | 4 |
| 54657 | 51 |
| 54657 | 51 |
| 54657 | 55 |
| 54658 | 2 |
| 54658 | 3 |
| 54658 | 1 |
| 54659 | 59 |
| 54659 | 58 |
| 54659 | 56 |
| 54660 | 33 |
| 54660 | 43 |
| 54660 | 44 |
| 54661 | 32 |
| 54661 | 45 |
| 54661 | 28 |
| 54662 | 57 |
| 54662 | 58 |
| 54662 | 58 |
| 54663 | 37 |
| 54663 | 33 |
| 54663 | 33 |
| 54664 | 43 |
| 54664 | 48 |
| 54664 | 48 |
| 54665 | 55 |
| 54665 | 51 |
| 54665 | 59 |
| 54666 | 51 |
| 54666 | 56 |
| 54666 | 54 |
| 54667 | 42 |
| 54667 | 46 |
| 54667 | 42 |
| 54668 | 53 |
| 54668 | 54 |
| 54668 | 55 |
| 54669 | 54 |
| 54669 | 38 |
| 54669 | 48 |
| 54670 | 2 |
| 54670 | 1 |
| 54670 | 2 |
| 54671 | 45 |
| 54671 | 49 |
| 54671 | 58 |
| 54672 | 3 |
| 54672 | 2 |
| 54672 | 1 |
| 54673 | 32 |
| 54673 | 31 |
| 54673 | 21 |
| 54674 | 32 |
| 54674 | 21 |
| 54674 | 34 |
| 54675 | 56 |
| 54675 | 62 |
| 54675 | 57 |
| 54676 | 57 |
| 54676 | 57 |
| 54676 | 57 |
| 54677 | 50 |
| 54677 | 38 |
| 54677 | 46 |
| 54678 | 40 |
| 54678 | 43 |
| 54678 | 44 |
| 54679 | 25 |
| 54679 | 39 |
| 54679 | 34 |
| 54680 | 43 |
| 54680 | 56 |
| 54680 | 48 |
| 54681 | 1 |
| 54681 | 2 |
| 54681 | 1 |
| 54682 | 4 |
| 54682 | 6 |
| 54682 | 3 |
| 54683 | 2 |
| 54683 | 2 |
| 54683 | 1 |
| 54684 | 41 |
| 54684 | 43 |
| 54684 | 47 |

Example 2

Variants Generated and Tested in an Isobutanol Production Pathway

TABLE 11

KARI Variants

| SEQ ID NO: | Variant Identifier | Amino Acid Substitutions relative to JEA1) | | | | | | |
|---|---|---|---|---|---|---|---|---|
| 6 | 54657 | Y286F | I291V | A336R | | | | |
| 11 | 54662 | Y286F | S322A | I152V | | | | |
| 2 | 54684 (JEA1) | | | | | | | |
| 33 | 65130 | S322A | I291V | A336R | | | | |
| 34 | 65131 | Y286F | S322A | A336R | | | | |
| 35 | 65132 | Y286F | S322A | I291V | | | | |
| 36 | 65133 | Y286F | S322A | I291V | A336R | | | |
| 37 | 65134 | S322A | I152V | A336R | | | | |
| 38 | 65135 | I291V | I152V | A336R | | | | |
| 39 | 65136 | S322A | I291V | I152V | | | | |
| 40 | 65137 | S322A | I291V | I152V | A336R | | | |
| 41 | 65138 | Y286F | I152V | A336R | | | | |
| 42 | 65139 | Y286F | S322A | I152V | A336R | | | |
| 43 | 65140 | Y286F | I291V | I152V | | | | |
| 44 | 65141 | Y286F | I291V | I152V | A336R | | | |
| 45 | 65142 | Y286F | S322A | I291V | I152V | | | |
| 46 | 65143 | Y286F | S322A | I291V | I152V | A336R | | |
| 47 | 65144 | Y286F | S322A | P47F | I291V | F50A | A336R | |
| 48 | 65145 | S322A | P47F | I291V | I152V | F50A | A336R | |
| 49 | 65146 | Y286F | S322A | P47F | I152V | F50A | A336R | |
| 50 | 65147 | Y286F | P47F | I291V | I152V | F50A | A336R | |
| 51 | 65148 | Y286F | S322A | P47F | I291V | I152V | F50A | |
| 52 | 65149 | Y286F | S322A | P47F | I291V | I152V | F50A | A336R |
| 53 | 65150 | Y286F | V76I | S322A | I291V | I152V | A336R | |
| 54 | 65151 | Y286F | V76I | S322A | I291V | A68E | A336R | |
| 55 | 65152 | S322A | I291V | I152V | I13L | A336R | | |
| 56 | 65153 | Y286F | V53A | S322A | I291V | A336R | A268E | |
| 57 | 65154 | Y286F | V76I | S322A | I291V | I152V | I13L | A336R |
| 58 | 65155 | I80T | I291V | I152V | I13L | A68E | A336R | |
| 59 | 65156 | Y286F | V117I | S322A | I152V | I13L | | |
| 60 | 65157 | Y286F | V76I | S322A | I291V | G72W | A71K | A336R |
| 61 | 65158 | Y286F | S322A | I291V | I152V | I13L | A336R | A329E |
| 62 | 65159 | Y286F | S86A | S322A | I80T | I152V | A68E | |
| 63 | 65160 | Y286F | S322A | I291V | I152V | I13L | F50N | A336R |
| 64 | 65161 | Y286F | V76I | S322A | I291V | G72W | A71K | A336R | A268T |

TABLE 12

Measured Isobutanol Titers (from PNY2238, anaerobic passage #2)

| Variant Identifier | Isobutanol Titer (mM) | Seq ID | Isobutanol Titer (mM) | Seq ID | Isobutanol Titer (mM) | Variant Identifier | Isobutanol Titer (mM) | Seq ID | Isobutanol Titer (mM) | Seq ID | Isobutanol Titer (mM) |
|---|---|---|---|---|---|---|---|---|---|---|---|
| 54657 | 53 | 65139 | 49 | 65150 | 86 | 65133 | 87 | 65145 | 47 | 65156 | 67 |
| 54657 | 53 | 65139 | 103 | 65151 | 54 | 65133 | 84 | 65145 | 67 | 65156 | 85 |
| 54657 | 69 | 65139 | 100 | 65151 | 49 | 65134 | 65 | 65145 | 94 | 65157 | 54 |
| 54662 | 61 | 65140 | 40 | 65151 | 81 | 65134 | 58 | 65145 | 70 | 65157 | 47 |
| 54662 | 63 | 65140 | 62 | 65151 | 91 | 65134 | 52 | 65146 | 55 | 65157 | 87 |
| 54662 | 62 | 65140 | 75 | 65152 | 67 | 65134 | 106 | 65146 | 46 | 65157 | 82 |
| 54662 | 80 | 65140 | 82 | 65152 | 45 | 65135 | 61 | 65146 | 48 | 65158 | 56 |
| 54684 | 52 | 65141 | 59 | 65152 | 98 | 65135 | 51 | 65146 | 103 | 65158 | 44 |
| 54684 | 33 | 65141 | 50 | 65152 | 100 | 65135 | 55 | 65147 | 57 | 65158 | 69 |
| 65130 | 53 | 65141 | 58 | 65153 | 38 | 65135 | 81 | 65147 | 47 | 65158 | 69 |
| 65130 | 61 | 65141 | 74 | 65153 | 53 | 65136 | 70 | 65147 | 49 | 65159 | 53 |
| 65130 | 67 | 65142 | 53 | 65153 | 62 | 65136 | 50 | 65147 | 86 | 65159 | 61 |
| 65130 | 85 | 65142 | 59 | 65153 | 77 | 65136 | 82 | 65148 | 55 | 65159 | 47 |
| 65131 | 55 | 65142 | 62 | 65154 | 47 | 65136 | 87 | 65148 | 48 | 65159 | 65 |
| 65131 | 49 | 65142 | 74 | 65154 | 66 | 65137 | 47 | 65148 | 69 | 65160 | 64 |
| 65131 | 56 | 65143 | 51 | 65154 | 77 | 65137 | 40 | 65148 | 63 | 65160 | 30 |
| 65131 | 100 | 65143 | 51 | 65154 | 60 | 65137 | 63 | 65149 | 45 | 65160 | 39 |
| 65132 | 44 | 65143 | 49 | 65155 | 47 | 65137 | 111 | 65149 | 47 | 65160 | 77 |
| 65132 | 54 | 65143 | 101 | 65155 | 49 | 65138 | 58 | 65149 | 55 | 65161 | 52 |
| 65132 | 55 | 65144 | 41 | 65155 | 51 | 65138 | 50 | 65149 | 73 | 65161 | 50 |
| 65132 | 85 | 65144 | 36 | 65155 | 85 | 65138 | 52 | 65150 | 44 | 65161 | 49 |
| 65133 | 56 | 65144 | 47 | 65156 | 58 | | | | | | |
| 65133 | 63 | 65144 | 76 | 65156 | 58 | | | | | | |

TABLE 12-continued

Measured Isobutanol Titers (from PNY2238, anaerobic passage #2)

| Variant Identifier | Isobutanol Titer (mM) | Seq ID | Isobutanol Titer (mM) | Seq ID | Isobutanol Titer (mM) |
|---|---|---|---|---|---|
| 65138 | 86 | 65150 | 82 | 65161 | 91 |
| 65139 | 28 | 65150 | 92 | | |

Example 3

Variants Generated and Tested in an Isobutanol Production Pathway

TABLE 13

KARI Variants

| SEQ ID NO: | Variant Identifier | Substitutions Relative to JEA1 (SEQ ID NO: 2) | | | | | | | |
|---|---|---|---|---|---|---|---|---|---|
| 2 | 54684 (JEA1) | | | | | | | | |
| 65 | 66824 | | | | I152V | Y286F | I291V | S322A | A336R |
| 66 | 66825 | R306K | N267T | | I152V | | I291V | S322A | A336R |
| 67 | 66826 | V76I | V171I | V156A | I152V | Y286F | I291V | S322A | A336R |
| 68 | 66827 | S292L | N114G | M238I | I152V | Y286F | I291V | S322A | A336R |
| 69 | 66828 | V76I | S292L | L88V | I152V | Y286F | I291V | S322A | A336R |
| 70 | 66829 | V156A | M238I | A329E | I152V | Y286F | I291V | S322A | A336R |
| 71 | 66830 | V156A | I127V | A68E | I152V | Y286F | I291V | S322A | A336R |
| 72 | 66831 | L88V | K99N | A277V | I152V | Y286F | I291V | S322A | A336R |
| 73 | 66832 | V156A | N114G | L33C | I152V | Y286F | I291V | S322A | A336R |
| 74 | 66833 | N267T | F61L | A68E | I152V | Y286F | I291V | S322A | A336R |
| 75 | 66834 | V171I | | L33C | | Y286F | I291V | S322A | A336R |
| 76 | 66835 | N114G | I127V | F61L | I152V | Y286F | I291V | S322A | A336R |
| 77 | 66836 | S292L | L88V | A329V | I152V | Y286F | I291V | S322A | A336R |
| 78 | 66837 | V171I | V156A | I127V | I152V | Y286F | I291V | S322A | A336R |
| 79 | 66838 | F61L | | A68E | I152V | | I291V | S322A | A336R |
| 80 | 66839 | R275K | I127V | A329V | I152V | Y286F | I291V | S322A | A336R |
| 81 | 66840 | I127V | F61L | A277V | I152V | Y286F | I291V | S322A | A336R |
| 82 | 66841 | V76I | | R306K | | Y286F | I291V | S322A | A336R |
| 83 | 66842 | V171I | L33C | | I152V | Y286F | I291V | | A336R |
| 84 | 66843 | | A68E | | I152V | | I291V | | A336R |
| 85 | 66844 | | R275K | A329E | | Y286F | I291V | S322A | A336R |
| 86 | 66845 | F61L | A329V | | I152V | Y286F | I291V | | A336R |
| 87 | 66846 | V152I | N114G | L88V | I152V | Y286F | I291V | S322A | A336R |
| 88 | 66847 | V76I | V156A | A277V | I152V | Y286F | I291V | S322A | A336R |
| 89 | 66848 | | R275K | | | | I291V | S322A | A336R |
| 90 | 66849 | R275K | K99N | | I152V | Y286F | I291V | | A336R |
| 91 | 66850 | V76I | A329E | A277V | I152V | Y286F | I291V | S322A | A336R |
| 92 | 66851 | V171I | F61L | | I152V | Y286F | I291V | | A336R |
| 93 | 66852 | L33C | | A68E | I152V | | I291V | S322A | A336R |
| 94 | 66853 | | N114G | A329E | | Y286F | I291V | S322A | A336R |
| 95 | 66854 | R306K | LK99N | A329V | I152V | Y286F | I291V | S322A | A336R |
| 96 | 66855 | N267T | M238I | L33C | I152V | Y286F | I291V | S322A | A336R |
| 97 | 66856 | S292L | L88V | A277V | I152V | Y286F | I291V | S322A | A336R |
| 98 | 66857 | S292L | R275K | L33C | I152V | Y286F | I291V | S322A | A336R |

TABLE 14

Measured Isobutanol Titers (from PNY2238, anaerobic passage #2)

| Variant Identifier | Isobutanol Titer (mM) |
|---|---|
| 54684 | 39 |
| 54684 | 38 |
| 54684 | 30 |
| 66824 | 50 |
| 66824 | 37 |
| 66825 | 35 |
| 66825 | 31 |
| 66825 | 17 |
| 66826 | 33 |
| 66826 | 27 |
| 66826 | 20 |
| 66827 | 42 |
| 66827 | 38 |
| 66828 | 28 |
| 66828 | 25 |
| 66829 | 44 |
| 66829 | 37 |
| 66829 | 31 |
| 66830 | 25 |
| 66830 | 22 |
| 66830 | 18 |
| 66831 | 30 |
| 66831 | 23 |
| 66831 | 12 |
| 66832 | 6 |
| 66832 | 5 |
| 66832 | 4 |
| 66833 | 9 |
| 66833 | 8 |

TABLE 14-continued

Measured Isobutanol Titers (from PNY2238, anaerobic passage #2)

| Variant Identifier | Isobutanol Titer (mM) |
|---|---|
| 66834 | 24 |
| 66834 | 18 |
| 66834 | 15 |
| 66835 | 24 |
| 66835 | 15 |
| 66836 | 31 |
| 66836 | 30 |
| 66836 | 26 |
| 66837 | 33 |
| 66837 | 27 |
| 66837 | 26 |
| 66838 | 31 |
| 66838 | 27 |
| 66838 | 21 |
| 66839 | 38 |
| 66839 | 28 |
| 66840 | 17 |
| 66840 | 16 |
| 66840 | 16 |
| 66841 | 41 |
| 66841 | 39 |
| 66841 | 30 |
| 66842 | 37 |
| 66842 | 22 |
| 66842 | 22 |
| 66843 | 36 |
| 66843 | 31 |
| 66844 | 36 |
| 66844 | 35 |
| 66844 | 27 |
| 66845 | 32 |
| 66845 | 25 |
| 66845 | 4 |
| 66846 | 37 |
| 66846 | 29 |
| 66847 | 31 |
| 66847 | 18 |
| 66847 | 16 |
| 66848 | 42 |
| 66848 | 25 |
| 66848 | 21 |
| 66849 | 55 |
| 66849 | 38 |
| 66850 | 40 |
| 66850 | 36 |
| 66850 | 30 |
| 66851 | 34 |
| 66851 | 32 |
| 66851 | 22 |
| 66852 | 20 |
| 66852 | 10 |
| 66853 | 36 |
| 66853 | 34 |
| 66853 | 34 |
| 66854 | 34 |
| 66854 | 28 |
| 66855 | 10 |
| 66855 | 9 |
| 66856 | 33 |
| 66856 | 26 |
| 66856 | 17 |
| 66857 | 24 |
| 66857 | 14 |
| 66857 | 14 |

Example 4

Variants Generated and Tested in an Isobutanol Production Pathway

TABLE 15

KARI Variants

| SEQ ID NO | Variant Identifier | Substitutions Relative to Variant identifier 65138 (SEQ ID NO: 41) | | | |
|---|---|---|---|---|---|
| 41 | 65138 | | | | |
| 99 | 76377 | A71K | | | |
| 100 | 76378 | G72W | | | |
| 101 | 76379 | N114G | | | |
| 102 | 76380 | M238I | | | |
| 103 | 76381 | R306K | | | |
| 104 | 76382 | A329E | | | |
| 105 | 76383 | A71K | G72W | | |
| 106 | 76384 | A71K | N114G | | |
| 107 | 76385 | A71K | M238I | | |
| 108 | 76386 | A71K | R306K | | |
| 109 | 76387 | A71K | A329E | | |
| 110 | 76388 | G72W | N114G | | |
| 111 | 76389 | G72W | M238I | | |
| 112 | 76390 | G72W | R306K | | |
| 113 | 76391 | G72W | A329E | | |
| 114 | 76392 | N114G | M238I | | |
| 115 | 76393 | N114G | R306K | | |
| 116 | 76394 | N114G | A329E | | |
| 117 | 76395 | M238I | R306K | | |
| 118 | 76396 | M238I | A329E | | |
| 119 | 76397 | R306K | A329E | | |
| 120 | 76398 | Y113F | R280L | | |
| 121 | 76399 | M238I | E264K | R280D | |
| 122 | 76400 | Y239H | F286W | | |
| 123 | 76401 | Y239H | A329R | | |
| 124 | 76402 | Y113F | A329E | | |
| 125 | 76403 | R280H | F286W | | |
| 126 | 76404 | A69K | A71K | | |
| 127 | 76405 | F286W | A329E | | |
| 128 | 76406 | R306K | S322A | | |
| 129 | 76407 | Q272T | A329R | | |
| 130 | 76408 | A69K | G72W | | |
| 131 | 76409 | N114S | A295V | | |
| 132 | 76410 | G72W | V152C | | |
| 133 | 76411 | N114S | R280H | | |
| 134 | 76412 | G72W | I291N | | |
| 135 | 76413 | A69K | K335M | | |
| 136 | 76414 | A71K | R280L | | |
| 137 | 76415 | A69T | M301I | | |
| 138 | 76416 | A69T | S322A | | |
| 139 | 76417 | E264K | R280D | A295V | |
| 140 | 76418 | N114G | K335M | | |
| 141 | 76419 | S157T | Y239H | | |
| 142 | 76420 | Q272T | R306K | | |
| 143 | 76421 | R280L | S322A | | |
| 144 | 76422 | N114G | A329R | | |
| 145 | 76423 | N114S | I291N | | |
| 146 | 76424 | E264K | R280D | M301I | |
| 147 | 76425 | Y113F | M301I | | |
| 148 | 76426 | R280H | A295V | | |
| 149 | 76427 | V152C | S157T | | |
| 150 | 76428 | S157T | I291N | | |
| 151 | 76429 | A69T | N114G | | |
| 152 | 76430 | Q272T | K335M | | |
| 153 | 76431 | V152C | M238I | | |
| 154 | 76432 | A69T | A71K | Y113F | |
| 155 | 76433 | E264K | R280D | A329R | K335M |
| 156 | 76434 | A69K | V152C | R280H | |
| 157 | 76435 | N114S | M301I | A329E | |
| 158 | 76436 | Q272T | F286W | A295V | |
| 159 | 76437 | G72W | N114G | Y239H | |
| 160 | 76438 | R280L | R306K | S322A | |
| 161 | 76439 | S157T | M238I | I291N | |

TABLE 16

Measured Isobutanol Titers (from PNY2259)

| Variant identifier | Cycle 1 Isobutanol Titer (mM) | Cycle 2 Isobutanol Titer (mM) |
|---|---|---|
| 65138 | 28 | 67 |
| 65138 | 34 | 57 |
| 65138 | 31 | 65 |
| 76377 | 22 | 60 |
| 76377 | 35 | 73 |
| 76377 | 27 | 59 |
| 76378 | 31 | 58 |
| 76378 | 32 | 71 |
| 76378 | 36 | 63 |
| 76379 | 39 | 57 |
| 76379 | 32 | 59 |
| 76379 | 31 | 66 |
| 76380 | 15 | 43 |
| 76380 | 30 | 68 |
| 76380 | 23 | 53 |
| 76381 | 18 | 31 |
| 76381 | 12 | 33 |
| 76381 | 9 | 23 |
| 76382 | 27 | 57 |
| 76382 | 32 | 77 |
| 76382 | 17 | 44 |
| 76383 | 37 | 62 |
| 76383 | 29 | 59 |
| 76383 | 31 | 63 |
| 76384 | 35 | 68 |
| 76384 | 36 | 66 |
| 76384 | 32 | 63 |
| 76385 | 36 | 71 |
| 76385 | 31 | 70 |
| 76385 | 30 | 62 |
| 76386 | 36 | 58 |
| 76386 | 29 | 59 |
| 76386 | 19 | 41 |
| 76387 | 38 | 58 |
| 76387 | 54 | 73 |
| 76387 | 22 | 56 |
| 76388 | 36 | 67 |
| 76388 | 20 | 49 |
| 76388 | 27 | 60 |
| 76389 | 29 | 54 |
| 76389 | 36 | 78 |
| 76389 | 28 | 83 |
| 76390 | 11 | 46 |
| 76390 | 8 | 24 |
| 76390 | 13 | 37 |
| 76391 | 22 | 51 |
| 76391 | 25 | 54 |
| 76391 | 28 | 64 |
| 76392 | 33 | 67 |
| 76392 | 41 | 67 |
| 76392 | 38 | 62 |
| 76393 | 3 | 4 |
| 76393 | 3 | 3 |
| 76393 | 5 | 7 |
| 76394 | 44 | 47 |
| 76394 | 44 | 74 |
| 76394 | 24 | 52 |
| 76395 | 4 | 8 |
| 76395 | 6 | 6 |
| 76395 | 6 | 11 |
| 76396 | 28 | 70 |
| 76396 | 26 | 60 |
| 76396 | 15 | 39 |
| 76397 | 13 | 40 |
| 76397 | 8 | 22 |
| 76397 | 6 | 15 |
| 76398 | 53 | 63 |
| 78398 | 23 | 59 |
| 76398 | 28 | 64 |
| 76399 | 27 | 51 |
| 76399 | 31 | 58 |
| 76399 | 30 | 75 |
| 76400 | 5 | 9 |
| 76400 | 11 | 14 |
| 76400 | 6 | 10 |
| 76401 | 48 | 63 |
| 76401 | 38 | 70 |
| 76401 | 48 | 65 |
| 76402 | 37 | 74 |
| 76402 | 32 | 61 |
| 76402 | 31 | 84 |
| 76403 | 2 | 3 |
| 76403 | 3 | 10 |
| 76403 | 3 | 6 |
| 76404 | 6 | 9 |
| 76404 | 5 | 7 |
| 76404 | 4 | 9 |
| 76405 | 3 | 3 |
| 76405 | 6 | 8 |
| 76405 | 2 | 2 |
| 76406 | 36 | 61 |
| 76406 | 18 | 41 |
| 76406 | 29 | 56 |
| 76407 | 28 | 57 |
| 76407 | 3 | 11 |
| 76407 | 35 | 65 |
| 76408 | 4 | 5 |
| 76408 | 2 | 4 |
| 76408 | 2 | 2 |
| 76409 | 36 | 57 |
| 76409 | 50 | 62 |
| 76409 | 32 | 84 |
| 76410 | 18 | 49 |
| 76410 | 31 | 55 |
| 76410 | 25 | 55 |
| 76411 | 18 | 56 |
| 76411 | 25 | 65 |
| 76411 | 17 | 46 |
| 76412 | 9 | 41 |
| 76412 | 15 | 37 |
| 76412 | 15 | 41 |
| 76413 | 2 | 3 |
| 76413 | 1 | 3 |
| 76413 | 3 | 5 |
| 76414 | 24 | 47 |
| 76414 | 37 | 58 |
| 76414 | 10 | 43 |
| 76415 | 47 | 83 |
| 76415 | 40 | 70 |
| 76415 | 44 | 61 |
| 76416 | 30 | 65 |
| 76416 | 34 | 66 |
| 76416 | 26 | 68 |
| 76417 | 31 | 61 |
| 76417 | 32 | 62 |
| 76417 | 20 | 52 |
| 76418 | 36 | 60 |
| 76418 | 65 | 71 |
| 76418 | 30 | 57 |
| 76419 | 33 | 63 |
| 76419 | 29 | 57 |
| 76419 | 32 | 65 |
| 76420 | 15 | 40 |
| 76420 | 18 | 35 |
| 76420 | 18 | 45 |
| 76421 | 39 | 64 |
| 76421 | 21 | 60 |
| 76421 | 47 | 65 |
| 76422 | 33 | 63 |
| 76422 | 37 | 62 |
| 76422 | 20 | 58 |
| 76423 | 1 | 2 |
| 76423 | 4 | 5 |
| 76423 | 2 | 3 |
| 76424 | 49 | 62 |
| 76424 | 39 | 62 |
| 76424 | 33 | 65 |
| 76425 | 48 | 72 |

TABLE 16-continued

Measured Isobutanol Titers (from PNY2259)

| Variant identifier | Cycle 1 Isobutanol Titer (mM) | Cycle 2 Isobutanol Titer (mM) |
|---|---|---|
| 76425 | 42 | 62 |
| 76425 | 23 | 62 |
| 76426 | 24 | 62 |
| 76426 | 13 | 51 |
| 76426 | 21 | 50 |
| 76427 | 18 | 51 |
| 76427 | 19 | 52 |
| 76427 | 25 | 52 |
| 76428 | 9 | 36 |
| 76428 | 16 | 34 |
| 76428 | 15 | 32 |
| 76429 | 31 | 66 |
| 76429 | 36 | 56 |
| 76429 | 31 | 65 |
| 76430 | 30 | 50 |
| 76430 | 26 | 66 |
| 76430 | 35 | 69 |
| 76431 | 25 | 55 |
| 76431 | 21 | 46 |
| 76431 | 22 | 57 |
| 76432 | 54 | 52 |
| 76432 | 40 | 75 |
| 76432 | 41 | 68 |
| 76433 | 47 | 55 |
| 76433 | 38 | 52 |
| 76433 | 31 | 62 |
| 76434 | 3 | 4 |
| 76434 | 0 | 3 |
| 76434 | 4 | 7 |
| 76435 | 46 | 61 |
| 76435 | 45 | 60 |
| 76435 | 35 | 56 |
| 76436 | 3 | 4 |
| 76436 | 5 | 5 |
| 76436 | 2 | 3 |
| 76437 | 53 | 82 |
| 76437 | 45 | 78 |
| 76437 | 40 | 68 |
| 76438 | 17 | 48 |
| 76438 | 10 | 39 |
| 76438 | 14 | 46 |
| 76439 | 21 | 48 |
| 76439 | 17 | 45 |
| 76439 | 17 | 38 |

Example 5

Variants for Isobutanol Production

Variants provided in Table 17 were generated and tested as described for Example 4, except the strain was PNY1556 (transformed with a single-plasmid as described above), Anaerobic cycles 1 and 2 were 3 days long, Cycle 3 was 2 days long. Results are given in Table 18.

TABLE 17

KARI Variants

| Seq ID NO: | Variant Number | Substitutions Relative to Variant Identifier 65139 (Seq ID NO: 42) | | | |
|---|---|---|---|---|---|
| 42 | 65139 | | | | |
| 123 | 76401 | Y239H | A322S | A329R | |
| 350 | 85023 | Y239H | | | |
| 351 | 85024 | A69T | | | |
| 352 | 85025 | A71K | | | |
| 353 | 85026 | Y113F | | | |
| 354 | 85027 | A69T | Y239H | | |
| 355 | 85028 | A71K | Y239H | | |
| 356 | 85029 | Y113F | Y239H | | |
| 357 | 85030 | A69T | A71K | | |
| 358 | 85031 | A69T | Y113F | | |
| 359 | 85032 | A71K | Y113F | | |
| 360 | 85033 | A69T | A71K | Y113F | |
| 361 | 85034 | A71K | Y113F | Y239H | |
| 362 | 85035 | A69T | Y113F | Y239H | |
| 363 | 85036 | A69T | A71K | Y239H | |
| 364 | 85037 | A69T | A71K | Y113F | Y239H |
| 365 | 85038 | A69T | M238I | Y239H | |
| 366 | 85039 | A71K | M238I | Y239H | |
| 367 | 85040 | Y113F | M238I | Y239H | |
| 368 | 85041 | A69T | A71K | M238I | |
| 369 | 85042 | A69T | Y113F | M238I | |
| 370 | 85043 | A71K | Y113F | M238I | |
| 371 | 85044 | A69T | Y239H | M301I | |
| 372 | 85045 | A71K | Y239H | M301I | |
| 373 | 85046 | Y113F | Y239H | M301I | |
| 374 | 85047 | A69T | A71K | M301I | |
| 375 | 85048 | A69T | Y113F | M301I | |
| 376 | 85049 | A71K | Y113F | M301I | |
| 377 | 85050 | A69T | Y239H | A322S | |
| 378 | 85051 | A71K | Y239H | A322S | |
| 379 | 85052 | Y113F | Y239H | A322S | |
| 380 | 85053 | A69T | A71K | A322S | |
| 381 | 85054 | A69T | Y113F | A322S | |
| 382 | 85055 | A71K | Y113F | A322S | |

TABLE 18

Measured Isobutanol Titers
Isobutanol Titer (mM)

| Variant Number | Cycle 1 | Cycle 2 | Cycle 3 |
|---|---|---|---|
| 65139 | 12 | 51 | 17 |
| 65139 | 5 | 49 | 30 |
| 65139 | 2 | 12 | 27 |
| 65139 | 2 | 13 | 34 |
| 76401 | 27 | 84 | 36 |
| 76401 | 12 | 70 | 48 |
| 76401 | 5 | 54 | 54 |
| 76401 | 2 | 9 | 18 |
| 85023 | 21 | 67 | 19 |
| 85023 | 13 | 59 | 32 |
| 85023 | 12 | 44 | 43 |
| 85023 | 6 | 59 | 52 |
| 85024 | 10 | 55 | 9 |
| 85024 | 5 | 32 | 22 |
| 85024 | 4 | 35 | 40 |
| 85024 | 2 | 9 | 4 |
| 85025 | 5 | 49 | 24 |
| 85025 | 4 | 27 | 18 |
| 85025 | 4 | 27 | 32 |
| 85025 | 1 | 3 | 2 |
| 85026 | 12 | 47 | 30 |
| 85026 | 3 | 9 | 5 |
| 85026 | 2 | 6 | 9 |
| 85026 | 2 | 12 | 31 |
| 85027 | 18 | 83 | 29 |
| 85027 | 16 | 62 | 38 |
| 85027 | 13 | 53 | 44 |
| 85027 | 2 | 20 | 18 |
| 85028 | 25 | 60 | 3 |
| 85028 | 22 | 62 | 23 |
| 85028 | 9 | 64 | 18 |
| 85028 | 7 | 52 | 39 |
| 85029 | 12 | 48 | 33 |

TABLE 18-continued

Measured Isobutanol Titers
Isobutanol Titer (mM)

| Variant Number | Cycle 1 | Cycle 2 | Cycle 3 |
|---|---|---|---|
| 85029 | 6 | 55 | 43 |
| 85029 | 5 | 44 | 45 |
| 85029 | 3 | 49 | 58 |
| 85030 | 11 | 48 | 20 |
| 85030 | 10 | 51 | 23 |
| 85030 | 4 | 30 | 19 |
| 85030 | 4 | 16 | 41 |
| 85031 | 12 | 49 | 17 |
| 85031 | 4 | 25 | 25 |
| 85031 | 4 | 29 | 40 |
| 85031 | 3 | 17 | 16 |
| 85032 | 9 | 50 | 11 |
| 85032 | 5 | 29 | 21 |
| 85032 | 3 | 16 | 17 |
| 85032 | 1 | 8 | 15 |
| 85033 | 9 | 53 | 13 |
| 85033 | 5 | 34 | 37 |
| 85033 | 4 | 20 | 8 |
| 85033 | 3 | 17 | 43 |
| 85034 | 18 | 65 | 22 |
| 85034 | 9 | 54 | 13 |
| 85034 | 6 | 51 | 34 |
| 85034 | 6 | 48 | 29 |
| 85035 | 15 | 65 | 22 |
| 85035 | 13 | 55 | 27 |
| 85035 | 5 | 39 | 45 |
| 85035 | 2 | 44 | 58 |
| 85036 | 20 | 58 | 17 |
| 85036 | 10 | 80 | 23 |
| 85036 | 6 | 48 | 54 |
| 85036 | 6 | 51 | 37 |
| 85037 | 20 | 56 | 13 |
| 85037 | 6 | 52 | 53 |
| 85037 | 3 | 31 | 70 |
| 85037 | 3 | 13 | 11 |
| — | — | — | — |
| — | — | — | — |
| — | — | — | — |
| 85038 | 27 | 81 | 37 |
| 85038 | 18 | 66 | 42 |
| 85038 | 16 | 68 | 35 |
| 85038 | 8 | 52 | 40 |
| 85039 | 28 | 70 | 19 |
| 85039 | 28 | 78 | 25 |
| 85039 | 9 | 61 | 52 |
| 85039 | 4 | 28 | 40 |
| 85040 | 26 | 77 | 36 |
| 85040 | 13 | 73 | 13 |
| 85040 | 10 | 62 | 30 |
| 85040 | 0 | 4 | 6 |
| 85041 | 21 | 60 | 23 |
| 85041 | 9 | 58 | 22 |
| 85041 | 6 | 47 | 62 |
| 85041 | 2 | 15 | 10 |
| 85042 | 8 | 56 | 37 |
| 85042 | 8 | 45 | 38 |
| 85042 | 4 | 38 | 54 |
| 85042 | 4 | 29 | 44 |
| 85043 | 18 | 62 | 22 |
| 85043 | 12 | 56 | 31 |
| 85043 | 10 | 60 | 40 |
| 85043 | 3 | 39 | 54 |
| 85044 | 19 | 53 | 10 |
| 85044 | 12 | 54 | 25 |
| 85044 | 8 | 40 | 33 |
| 85044 | 2 | 23 | 43 |
| 85045 | 12 | 50 | 18 |
| 85045 | 4 | 17 | 9 |
| 85045 | 3 | 14 | 32 |
| 85045 | 3 | 19 | 37 |
| 85046 | 6 | 44 | 21 |
| 85046 | 4 | 30 | 18 |
| 85046 | 3 | 9 | 8 |
| 85046 | 2 | 6 | 8 |
| 85047 | 3 | 13 | 7 |
| 85047 | 3 | 16 | 8 |
| 85047 | 3 | 14 | 19 |
| 85047 | 2 | 11 | 12 |
| 85048 | 6 | 31 | 6 |
| 85048 | 1 | 4 | 4 |
| 85048 | 0 | 2 | 2 |
| 85048 | 0 | 9 | 55 |
| 85049 | 3 | 13 | 8 |
| 85049 | 2 | 6 | 4 |
| 85049 | 0 | 0 | 0 |
| 85049 | 0 | 0 | 0 |
| 85050 | 24 | 70 | 37 |
| 85050 | 21 | 68 | 27 |
| 85050 | 20 | 70 | 21 |
| 85050 | 4 | 25 | 30 |
| 85051 | 24 | 65 | 36 |
| 85051 | 23 | 72 | 21 |
| 85051 | 6 | 65 | 40 |
| 85051 | 6 | 55 | 63 |
| 85052 | 27 | 77 | 24 |
| 85052 | 15 | 57 | 25 |
| 85052 | 10 | 59 | 36 |
| 85052 | 10 | 60 | 52 |
| 85053 | 14 | 50 | 7 |
| 85053 | 8 | 49 | 22 |
| 85053 | 3 | 20 | 6 |
| 85053 | 0 | 20 | 44 |
| 85054 | 11 | 53 | 19 |
| 85054 | 4 | 54 | 29 |
| 85054 | 1 | 6 | 2 |
| 85054 | 0 | 2 | 2 |
| 85055 | 4 | 10 | 1 |
| 85055 | 2 | 5 | 1 |
| 85055 | 1 | 4 | 2 |
| 85055 | 1 | 4 | 0 |

Example 6

Identification of Suitable Substitutions by Site-Saturation for Residues 152, 286, 336

All 20 amino acids at sites 152, 286, and 336 of parent variant R8—SOG1_y2 (amino acid SEQ ID NO: 346; nucleic acid SEQ ID NO: 383) were individually constructed and tested. This parent variant is JEA1 with substitutions A68E, I152V, Y286F, and A336R.

The General Methods are the same as in the application for Examples 1-4. The two-plasmid system was used, with KARI on a pLH556-based plasmid, and DHAD on pBP915. The yeast strain was PNY2259.

Site-Directed Mutagenesis and Subcloning into pLH556-Based Vector:

Position 152 was mutagenized by overlap-extension PCR with mutagenic primers. The KARI inserts were subcloned into pLH556 (with the KARI removed) by yeast gap-repair cloning. The sequence of the KARI portion and flanking regions of the resulting plasmids was confirmed by DNA sequencing (Sanger method, ABI Prism 3730xl DNA Analyzer), Positions 286 and 336 were mutagenized using the QuikChangeII kit (Agilent); position 286 in a pCR2.1 vector (invitrogen) and position 336 in a TOPO Blunt vector (Invitrogen). The KARI variants were sequenced in the Invitrogen vectors, then subcloned by standard ligation into the PmeI and SfiI restriction sites of pLH556. The KARI inserts were confirmed by sequencing again in the pLH556 vector.

The resulting 60 variants are characterized in the table below as either functional (F, defined as supporting a mean yeast isobutanol production of at least 10% of the mean of the parent, or non-functional (NF, defined as not supporting a mean yeast isobutanol production of at least 10% of the mean of the parent).

Quantitative data (percentages of parental isobutanol titer) are provided in the second table. Data are based on the first anaerobic passaging cycle.

TABLE 19

Substitutions

| Amino Acid | Position 152 (F/NF) | Position 286 (F/NF) | Position 336 (F/NF) |
|---|---|---|---|
| A, Ala | F | F | F |
| C, Cys | F | F | F |
| D, Asp | F | NF | F |
| E, Glu | F | NF | F |
| F, Phe | F | F | F |
| G, Gly | F | NF | F |
| H, His | F | F | F |
| I, Ile | F | F | F |
| K, Lys | F | NF | F |
| L, Leu | F | NF | F |
| M, Met | F | F | F |
| N, Asn | F | NF | F |
| P, Pro | F | NF | F |
| Q, Gln | F | NF | F |
| R, Arg | F | NF | F |
| S, Ser | F | NF | F |
| T, Thr | F | NF | F |
| V, Val | F | NF | F |
| W, Trp | F | F | F |
| Y, Tyr | F | F | F |

TABLE 20

Quantitative Data for the substitutions in Table 24 (expressed as a percentage of the parent's mean isobutanol titer) - First Anaerobic Cycle

| Amino Acid | % of Parental Isobutanol Titer, Position 152 | % of Parental Isobutanol Titer, Position 286 | % of Parental Isobutanol Titer, Position 336 |
|---|---|---|---|
| A, Ala | 51% | 16% | 106% |
| C, Cys | 128% | 15% | 98% |
| D, Asp | 54% | 1% | 112% |
| E, Glu | 77% | 1% | 89% |
| F, Phe | 67% | 100% | 114% |
| G, Gly | 25% | 1% | 95% |
| H, His | 90% | 38% | 121% |
| I, Ile | 46% | 30% | 89% |
| K, Lys | 61% | 2% | 126% |
| L, Leu | 52% | 10% | 103% |
| M, Met | 53% | 40% | 94% |
| N, Asn | 57% | 1% | 87% |
| P, Pro | 34% | 1% | 76% |
| Q, Gln | 82% | 5% | 131% |
| R, Arg | 42% | 3% | 100% |
| S, Ser | 86% | 6% | 115% |
| T, Thr | 89% | 3% | 100% |
| V, Val | 100% | 9% | 96% |
| W, Trp | 82% | 17% | 100% |
| Y, Tyr | 46% | 51% | 132% |

SEQUENCE LISTING (391 sequences)

SEQ ID NO: 1 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 2 - protein, 338 aa, Artificial sequence
  KARI variant JEA1
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 3 - protein, 338 aa, Artificial sequence
  KARI variant 54654
MKVFYDKDCDLSIIQGKKVAIIGFGSQGHAQALNLKDSGVDVTVGLFKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFIAEGATGYPSMTAKRRNNAAHGIEIIGEQLRAMMPWIGANKIVDKAKN

SEQ ID NO: 4 - protein, 338 aa, Artificial sequence
  KARI variant 54655
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKAKN

SEQ ID NO: 5 - protein, 338 aa, Artificial sequence
  KARI variant 54656
MKVFYDKDCDLSIIQGKKVAIIGFGSQGHAQALNLKDSGVDVTVGLFKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKRKN

SEQ ID NO: 6 - protein, 338 aa, Artificial sequence
  KARI variant 54657
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 7 - protein, 338 aa, Artificial sequence
  KARI variant 54658
MKVFYDKDCDLSIIQGKKVAIIGFGSQGHAQALNLKDSGVDVTVGLFKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKGKN

SEQ ID NO: 8 - protein, 338 aa, Artificial sequence
  KARI variant 54659
MKVFYDKDCDLSIIQGKKVAIIGFGSQGHAQALNLKDSGVDVTVGLPKGFADVAKAEAHGFKVTDVAAAVAGADLVMILIPDEFQSQVYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 9 - protein, 338 aa, Artificial sequence
  KARI variant 54660
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKGKN

SEQ ID NO: 10 - protein, 338 aa, Artificial sequence
  KARI variant 54661
MKVFYDKDCDLSLIQGKKVAIIGFGSQGHAQALNLKDSGVDVTVGLPKGFADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKAKN

SEQ ID NO: 11 - protein, 338 aa, Artificial sequence
  KARI variant 54662
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKAKN

SEQ ID NO: 12 - protein, 338 aa, Artificial sequence
  KARI variant 54663
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRQAMRNALKRIQDGEYAKMFIAEGATGYPSMTAKRRNNAAHGIEIIGEQLRSMMPWIGANKIVDKAKN

SEQ ID NO: 13 - protein, 338 aa, Artificial sequence
  KARI variant 54664
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRQAMRNALKRIQDGEFAKMFISEGATGYPSMTAKRRNNAAHGIEIIGEQLRAMMPWIGANKIVDKGKN

SEQ ID NO: 14 - protein, 338 aa, Artificial sequence
  KARI variant 54665
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVAEGATGYPSMTAKRRNNAAHGIEIIGEQLRAMMPWIGANKIVDKAKN

SEQ ID NO: 15 - protein, 338 aa, Artificial sequence
  KARI variant 54666
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFIAEGATGYPSMTAKRRNNAAHGIEIIGEQLRAMMPWIGANKIVDKRKN

SEQ ID NO: 16 - protein, 338 aa, Artificial sequence
  KARI variant 54667
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 17 - protein, 338 aa, Artificial sequence
  KARI variant 54668
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 18 - protein, 338 aa, Artificial sequence
  KARI variant 54669
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFIAEGATGYPSMTAKRRNNAAHGIEIIGEQLRAMMPWIGANKIVDKRKN

SEQ ID NO: 19 - protein, 338 aa, Artificial sequence
  KARI variant 54670
MKVFYDKDCDLSIIQGKKVAIIGFGSQGHAQALNLKDSGVDVTVGLFKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 20 - protein, 338 aa, Artificial sequence
  KARI variant 54671
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 21 - protein, 338 aa, Artificial sequence
  KARI variant 54672
MKVFYDKDCDLSIIQGKKVAIIGFGSQGHAQALNLKDSGVDVTVGLFKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 22 - protein, 338 aa, Artificial sequence
  KARI variant 54673
MKVFYDKDCDLSIIQGKKVAIIGFGSQGHAQALNLKDSGVDVTVGLPKGFADVAKAEAHGFKVTDVAAAVAGADLIMILIPDEFQSQVYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRAMMPWIGANKIVDKRKN

SEQ ID NO: 23 - protein, 338 aa, Artificial sequence
  KARI variant 54674
MKVFYDKDCDLSIIQGKKVAIIGFGSQGHAQALNLKDSGVDVTVGLPKGFADVAKAEAHGFKVTDVAAAVAGADLIMILIPDEFQSQVYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFIAEGATGYPSMTAKRRNNAAHGIEIIGEQLRAMMPWIGANKIVDKGKN

SEQ ID NO: 24 - protein, 338 aa, Artificial sequence
  KARI variant 54675
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 25 - protein, 338 aa, Artificial sequence
  KARI variant 54676
MKVFYDKDCDLSIIQGKKVAIIGFGSQGHAQALNLKDSGVDVTVGLPKGFADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRQAMRNALKRIQDGEFAKMFVSEGATGYPSMTAKRRNNAAHGIEIIGEQLRSMMPWIGANKIVDKRKN

SEQ ID NO: 26 - protein, 338 aa, Artificial sequence
  KARI variant 54677
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKGKN

SEQ ID NO: 27 - protein, 338 aa, Artificial sequence
  KARI variant 54678
MKVFYDKDCDLSLIQGKKVAIIGFGSQGHAQALNLKDSGVDVTVGLPKGFADVAKAEAHGFKVTDVAAAVAGADLVMILIPDEFQSQVYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVAEGATGYPSMTAKRRNNAAHGIEIIGEQLRSMMPWIGANKIVDKAKN

SEQ ID NO: 28 - protein, 338 aa, Artificial sequence
  KARI variant 54679
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRQAMRNALKRIQDGEFAKMFVSEGATGYPSMTAKRRNNAAHGIEIIGEQLRSMMPWIGANKIVDKGKN

SEQ ID NO: 29 - protein, 338 aa, Artificial sequence
  KARI variant 54680
MKVFYDKDCDLSLIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFIAEGATGYPSMTAKRRNNAAHGIEIIGEQLRSMMPWIGANKIVDKRKN

SEQ ID NO: 30 - protein, 338 aa, Artificial sequence
  KARI variant 54681
MKVFYDKDCDLSLIQGKKVAIIGFGSQGHAQALNLKDSGVDVTVGLFKGFADAAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 31 - protein, 338 aa, Artificial sequence
  KARI variant 54682
MKVFYDKDCDLSIIQGKKVAIIGFGSQGHAQALNLKDSGVDVTVGLFKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKGKN

SEQ ID NO: 32 - protein, 338 aa, Artificial sequence
  KARI variant 54683
MKVFYDKDCDLSIIQGKKVAIIGFGSQGHAQALNLKDSGVDVTVGLFKGFADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRAMMPWIGANKIVDKGKN

SEQ ID NO: 33 - protein, 338 aa, Artificial sequence
  KARI variant 65130
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 34 - protein, 338 aa, Artificial sequence
  KARI variant 65131
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 35 - protein, 338 aa, Artificial sequence
  KARI variant 65132
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKAKN

SEQ ID NO: 36 - protein, 338 aa, Artificial sequence
  KARI variant 65133
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 37 - protein, 338 aa, Artificial sequence
  KARI variant 65134
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRAMMPWIGANKIVDKRKN

SEQ ID NO: 38 - protein, 338 aa, Artificial sequence
  KARI variant 65135
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 39 - protein, 338 aa, Artificial sequence
  KARI variant 65136
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKAKN

SEQ ID NO: 40 - protein, 338 aa, Artificial sequence
  KARI variant 65137
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 41 - protein, 338 aa, Artificial sequence
  KARI variant 65138
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 42 - protein, 338 aa, Artificial sequence
  KARI variant 65139
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 43 - protein, 338 aa, Artificial sequence
  KARI variant 65140
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKAKN

SEQ ID NO: 44 - protein, 338 aa, Artificial sequence
  KARI variant 65141
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 45 - protein, 338 aa, Artificial sequence
  KARI variant 65142
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKAKN

SEQ ID NO: 46 - protein, 338 aa, Artificial sequence
  KARI variant 65143
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 47 - protein, 338 aa, Artificial sequence
  KARI variant 65144
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 48 - protein, 338 aa, Artificial sequence
  KARI variant 65145
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 49 - protein, 338 aa, Artificial sequence
  KARI variant 65146
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 50 - protein, 338 aa, Artificial sequence
  KARI variant 65147
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 51 - protein, 338 aa, Artificial sequence
  KARI variant 65148
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKAKN

SEQ ID NO: 52 - protein, 338 aa, Artificial sequence
  KARI variant 65149
MKVFYDKDCDLSIIQGKKVAIIGFGSQGHAQALNLKDSGVDVTVGLFKGAADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 53 - protein, 338 aa, Artificial sequence
  KARI variant 65150
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 54 - protein, 338 aa, Artificial sequence
  KARI variant 65151
MKVFYDKDCDLSIIQGKKVAIIGFGSQGHAQALNLKDSGVDVTVGLPKGFADVAKAEAHGFKVTDVAEAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 55 - protein, 338 aa, Artificial sequence
  KARI variant 65152
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 56 - protein, 338 aa, Artificial sequence
  KARI variant 65153
MKVFYDKDCDLSIIQGKKVAIIGFGSQGHAQALNLKDSGVDVTVGLPKGFADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINEESRQAMRNALKRIQDGEFAKMFVSEGATGYPSMTAKRRNNAAHGIEIIGEQLRAMMPWIGANKIVDKRKN

SEQ ID NO: 57 - protein, 338 aa, Artificial sequence
  KARI variant 65154
MKVFYDKDCDLSLIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 58 - protein, 338 aa, Artificial sequence
  KARI variant 65155
MKVFYDKDCDLSLIQGKKVAIIGFGSQGHAQALNLKDSGVDVTVGLPKGFADVAKAEAHGFKVTDVAEAVAGADLVMILTPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 59 - protein, 338 aa, Artificial sequence
  KARI variant 65156
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVIPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKAKN

SEQ ID NO: 60 - protein, 338 aa, Artificial sequence
  KARI variant 65157
MKVFYDKDCDLSIIQGKKVAIIGFGSQGHAQALNLKDSGVDVTVGLPKGFADVAKAEAHGFKVTDVAAAVKWADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 61 - protein, 338 aa, Artificial sequence
  KARI variant 65158
MKVFYDKDCDLSLIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGENKIVDKRKN

SEQ ID NO: 62 - protein, 338 aa, Artificial sequence
  KARI variant 65159
MKVFYDKDCDLSIIQGKKVAIIGFGSQGHAQALNLKDSGVDVTVGLPKGFADVAKAEAHGFKVTDVAEAVAGADLVMILTPDEFQAQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKAKN

SEQ ID NO: 63 - protein, 338 aa, Artificial sequence
  KARI variant 65160
MKVFYDKDCDLSLIQGKKVAIIGFGSQGHAQALNLKDSGVDVTVGLPKGNADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 64 - protein, 338 aa, Artificial sequence
  KARI variant 65161
MKVFYDKDCDLSIIQGKKVAIIGFGSQGHAQALNLKDSGVDVTVGLPKGFADVAKAEAHGFKVTDVAAAVKWADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINTESRQAMRNALKRIQDGEFAKMFVSEGATGYPSMTAKRRNNAAHGIEIIGEQLRAMMPWIGANKIVDKRKN

SEQ ID NO: 65 - protein, 338 aa, Artificial sequence; identical to SEQ ID NO: 46
  KARI variant 66824

SEQ ID NO: 66 - protein, 338 aa, Artificial sequence
  KARI variant 66825
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVITAESRQAMRNALKRIQDGEYAKMFVSEGATGYPSMTAKRKNNAAHGIEIIGEQLRAMMPWIGANKIVDKRKN

SEQ ID NO: 67 - protein, 338 aa, Artificial sequence
  KARI variant 66826
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDASGNAKNVALSYAAGIGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 68 - protein, 338 aa, Artificial sequence
  KARI variant 66827
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFVLEGATGYPSMTAKRRNNAAHGIEIIGEQLRAMMPWIGANKIVDKRKN

SEQ ID NO: 69 - protein, 338 aa, Artificial sequence
  KARI variant 66828
MKVFYDKDCDLSIIQGKKVAIIGFGSQGHAQALNLKDSGVDVTVGLPKGFADVAKAEAHGFKVTDVAAAVAGADLIMILIPDEFQSQVYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVLEGATGYPSMTAKRRNNAAHGIEIIGEQLRAMMPWIGANKIVDKRKN

SEQ ID NO: 70 - protein, 338 aa, Artificial sequence
  KARI variant 66829
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDASGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFVSEGATGYPSMTAKRRNNAAHGIEIIGEQLRAMMPWIGENKIVDKRKN

SEQ ID NO: 71 - protein, 338 aa, Artificial sequence
  KARI variant 66830
MKVFYDKDCDLSIIQGKKVAIIGFGSQGHAQALNLKDSGVDVTVGLPKGFADVAKAEAHGFKVTDVAEAVAGADLVMILIPDEFQSQLYKNEIEPNIKKGATLAFSHGFAIHYNQVVPRADLDVIMVAPKAPGHTVRSEFVKGGGIPDLIAVYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 72 - protein, 338 aa, Artificial sequence
  KARI variant 66831
MKVFYDKDCDLSIIQGKKVAIIGFGSQGHAQALNLKDSGVDVTVGLPKGFADVAKAEAHGFKVTDVAAAVAGADLVMILIPDEFQSQVYKNEIEPNIKNGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNVLKRIQDGEFAKMFVSEGATGYPSMTAKRRNNAAHGIEIIGEQLRAMMPWIGANKIVDKRKN

SEQ ID NO: 73 - protein, 338 aa, Artificial sequence
  KARI variant 66832
MKVFYDKDCDLSIIQGKKVAIIGFGSQGHAQACNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 74 - protein, 338 aa, Artificial sequence
  KARI variant 66833
MKVFYDKDCDLSIIQGKKVAIIGFGSQGHAQALNLKDSGVDVTVGLPKGFADVAKAEAHGLKVTDVAEAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVITAESRQAMRNALKRIQDGEFAKMFVSEGATGYPSMTAKRRNNAAHGIEIIGEQLRAMMPWIGANKIVDKRKN

SEQ ID NO: 75 - protein, 338 aa, Artificial sequence
  KARI variant 66834
MKVFYDKDCDLSIIQGKKVAIIGFGSQGHAQACNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGIGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 76 - protein, 338 aa, Artificial sequence
  KARI variant 66835
MKVFYDKDCDLSIIQGKKVAIIGFGSQGHAQALNLKDSGVDVTVGLPKGFADVAKAEAHGLKVTDVAAAVAGADLVMILIPDEFQSQLYKNEIEPNIKKGATLAFSHGFAIHYGQVVPRADLDVIMVAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 77 - protein, 338 aa, Artificial sequence
  KARI variant 66836
MKVFYDKDCDLSIIQGKKVAIIGFGSQGHAQALNLKDSGVDVTVGLPKGFADVAKAEAHGFKVTDVAAAVAGADLVMILIPDEFQSQVYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVLEGATGYPSMTAKRRNNAAHGIEIIGEQLRAMMPWIGVNKIVDKRKN

SEQ ID NO: 78 - protein, 338 aa, Artificial sequence
  KARI variant 66837
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMVAPKAPGHTVRSEFVKGGGIPDLIAVYQDASGNAKNVALSYAAGIGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 79 - protein, 338 aa, Artificial sequence
  KARI variant 66838
MKVFYDKDCDLSIIQGKKVAIIGFGSQGHAQALNLKDSGVDVTVGLPKGFADVAKAEAHGLKVTDVAEAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 80 - protein, 338 aa, Artificial sequence
  KARI variant 66839
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMVAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMKNALKRIQDGEFAKMFVSEGATGYPSMTAKRRNNAAHGIEIIGEQLRAMMPWIGVNKIVDKRKN

SEQ ID NO: 81 - protein, 338 aa, Artificial sequence
  KARI variant 66840
MKVFYDKDCDLSIIQGKKVAIIGFGSQGHAQALNLKDSGVDVTVGLPKGFADVAKAEAHGLKVTDVAAAVAGADLVMILIPDEFQSQLYKNEIEPNIKKGATLAFSHGFAIHYNQVVPRADLDVIMVAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNVLKRIQDGEFAKMFVSEGATGYPSMTAKRRNNAAHGIEIIGEQLRAMMPWIGANKIVDKRKN

SEQ ID NO: 82 - protein, 338 aa, Artificial sequence
  KARI variant 66841
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRKNNAAHGIEIIGEQLRAMMPWIGANKIVDKRKN

SEQ ID NO: 83 - protein, 338 aa, Artificial sequence
  KARI variant 66842
MKVFYDKDCDLSIIQGKKVAIIGFGSQGHAQACNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGIGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 84 - protein, 338 aa, Artificial sequence
  KARI variant 66843
MKVFYDKDCDLSIIQGKKVAIIGFGSQGHAQALNLKDSGVDVTVGLPKGFADVAKAEAHGFKVTDVAEAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRSMMPWIGANKIVDKRKN

SEQ ID NO: 85 - protein, 338 aa, Artificial sequence
  KARI variant 66844
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMKNALKRIQDGEFAKMFVSEGATGYPSMTAKRRNNAAHGIEIIGEQLRAMMPWIGENKIVDKRKN

SEQ ID NO: 86 - protein, 338 aa, Artificial sequence
  KARI variant 66845
MKVFYDKDCDLSIIQGKKVAIIGFGSQGHAQALNLKDSGVDVTVGLPKGFADVAKAEAHGLKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGVNKIVDKRKN

SEQ ID NO: 87 - protein, 338 aa, Artificial sequence
  KARI variant 66846
MKVFYDKDCDLSIIQGKKVAIIGFGSQGHAQALNLKDSGVDVTVGLPKGFADVAKAEAHGFKVTDVAAAVAGADLVMILIPDEFQSQVYKNEIEPNIKKGATLAFSHGFAIHYGQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGANKIVDKRKN

SEQ ID NO: 88 - protein, 338 aa, Artificial sequence
  KARI variant 66847
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNVLKRIQDGEFAKMFVSEGATGYPSMTAKRRNNAAHGIEIIGEQLRAMMPWIGANKIVDKRKN

SEQ ID NO: 89 - protein, 338 aa, Artificial sequence
  KARI variant 66848
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMKNALKRIQDGEYAKMFVSEGATGYPSMTAKRRNNAAHGIEIIGEQLRAMMPWIGANKIVDKRKN

SEQ ID NO: 90 - protein, 338 aa, Artificial sequence
  KARI variant 66849
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKNGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMKNALKRIQDGEFAKMFVSEGATGYPSMTAKRRNNAAHGIEIIGEQLRSMMPWIGANKIVDKRKN

SEQ ID NO: 91 - protein, 338 aa, Artificial sequence
  KARI variant 66850
MKVFYDKDCDLSIIQGKKVAIIGFGSQGHAQALNLKDSGVDVTVGLPKGFADVAKAEAHGFKVTDVAAAVAGADLIMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNVLKRIQDGEFAKMFVSEGATGYPSMTAKRRNNAAHGIEIIGEQLRAMMPWIGENKIVDKRKN

SEQ ID NO: 92 - protein, 338 aa, Artificial sequence
  KARI variant 66851
MKVFYDKDCDLSIIQGKKVAIIGFGSQGHAQALNLKDSGVDVTVGLPKGFADVAKAEAHGLKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGIGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRSMMPWIGANKIVDKRKN

SEQ ID NO: 93 - protein, 338 aa, Artificial sequence
  KARI variant 66852
MKVFYDKDCDLSIIQGKKVAIIGFGSQGHAQACNLKDSGVDVTVGLPKGFADVAKAEAHGFKVTDVAEAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFVSEGATGYPSMTAKRRNNAAHGIEIIGEQLRAMMPWIGANKIVDKRKN

SEQ ID NO: 94 - protein, 338 aa, Artificial sequence
  KARI variant 66853
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRRNNAAHGIEIIGEQLRAMMPWIGENKIVDKRKN

SEQ ID NO: 95 - protein, 338 aa, Artificial sequence
  KARI variant 66854
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKNGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFVSEGATGYPSMTAKRKNNAAHGIEIIGEQLRAMMPWIGVNKIVDKRKN

SEQ ID NO: 96 - protein, 338 aa, Artificial sequence
  KARI variant 66855
MKVFYDKDCDLSIIQGKKVAIIGFGSQGHAQACNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVITAESRQAMRNALKRIQDGEFAKMFVSEGATGYPSMTAKRRNNAAHGIEIIGEQLRAMMPWIGANKIVDKRKN

SEQ ID NO: 97 - protein, 338 aa, Artificial sequence
  KARI variant 66856
MKVFYDKDCDLSIIQGKKVAIIGFGSQGHAQALNLKDSGVDVTVGLPKGFADVAKAEAHGFKVTDVAAAVAGADLVMILIPDEFQSQVYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNVLKRIQDGEFAKMFVLEGATGYPSMTAKRRNNAAHGIEIIGEQLRAMMPWIGANKIVDKRKN

SEQ ID NO: 98 - protein, 338 aa, Artificial sequence
  KARI variant 66857
MKVFYDKDCDLSIIQGKKVAIIGFGSQGHAQACNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMKNALKRIQDGEFAKMFVLEGATGYPSMTAKRRNNAAHGIEIIGEQLRAMMPWIGANKIVDKRKN

SEQ ID NO: 99 - protein, 338 aa, Artificial sequence
  KARI variant 76377
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 100 - protein, 338 aa, Artificial sequence
  KARI variant 76378
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 101 - protein, 338 aa, Artificial sequence
  KARI variant 76379
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 102 - protein, 338 aa, Artificial sequence
  KARI variant 76380
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 103 - protein, 338 aa, Artificial sequence
  KARI variant 76381
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRSMMPWIGANKIVDKRKN

SEQ ID NO: 104 - protein, 338 aa, Artificial sequence
  KARI variant 76382
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 105 - protein, 338 aa, Artificial sequence
  KARI variant 76383
MKVFYDKDCDLSIIQGKKVAIIGFGSQGHAQALNLKDSGVDVTVGLPKGFADVAKAEAHGFKVTDVAAAVKWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 106 - protein, 338 aa, Artificial sequence
  KARI variant 76384
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 107 - protein, 338 aa, Artificial sequence
  KARI variant 76385
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 108 - protein, 338 aa, Artificial sequence
  KARI variant 76386
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRSMMPWIGANKIVDKRKN

SEQ ID NO: 109 - protein, 338 aa, Artificial sequence
  KARI variant 76387
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 110 - protein, 338 aa, Artificial sequence
  KARI variant 76388
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 111 - protein, 338 aa, Artificial sequence
  KARI variant 76389
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 112 - protein, 338 aa, Artificial sequence
  KARI variant 76390
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRSMMPWIGANKIVDKRKN

SEQ ID NO: 113 - protein, 338 aa, Artificial sequence
  KARI variant 76391
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 114 - protein, 338 aa, Artificial sequence
  KARI variant 76392
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 115 - protein, 338 aa, Artificial sequence
  KARI variant 76393
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRSMMPWIGANKIVDKRKN

SEQ ID NO: 116 - protein, 338 aa, Artificial sequence
  KARI variant 76394
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 117 - protein, 338 aa, Artificial sequence
  KARI variant 76395
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRKNNAAHGIEIIGEQLRSMMPWIGANKIVDKRKN

SEQ ID NO: 118 - protein, 338 aa, Artificial sequence
  KARI variant 76396
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 119 - protein, 338 aa, Artificial sequence
  KARI variant 76397
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRSMMPWIGENKIVDKRKN

SEQ ID NO: 120 - protein, 338 aa, Artificial sequence
  KARI variant 76398
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKLIQDGEFAKMFISEGATGYPSMTAKRRNNAAHGIEIIGEQLRSMMPWIGANKIVDKRKN

SEQ ID NO: 121 - protein, 338 aa, Artificial sequence
  KARI variant 76399
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPKVINAESRQAMRNALKDIQDGEFAKMFISEGATGYPSMTAKRRNNAAHGIEIIGEQLRSMMPWIGANKIVDKRKN

SEQ ID NO: 122 - protein, 338 aa, Artificial sequence
  KARI variant 76400
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEWAKMFISEGATGYPSMTAKRRNNAAHGIEIIGEQLRSMMPWIGANKIVDKRKN

SEQ ID NO: 123 - protein, 338 aa, Artificial sequence
  KARI variant 76401
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGRNKIVDKRKN

SEQ ID NO: 124 - protein, 338 aa, Artificial sequence
  KARI variant 76402
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGENKIVDKRKN

SEQ ID NO: 125 - protein, 338 aa, Artificial sequence
  KARI variant 76403
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKHIQDGEWAKMFISEGATGYPSMTAKRRNNAAHGIEIIGEQLRSMMPWIGANKIVDKRKN

SEQ ID NO: 126 - protein, 338 aa, Artificial sequence
  KARI variant 76404
MKVFYDKDCDLSIIQGKKVAIIGFGSQGHAQALNLKDSGVDVTVGLPKGFADVAKAEAHGFKVTDVAAKVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 127 - protein, 338 aa, Artificial sequence
  KARI variant 76405
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEWAKMFISEGATGYPSMTAKRRNNAAHGIEIIGEQLRSMMPWIGENKIVDKRKN

SEQ ID NO: 128 - protein, 338 aa, Artificial sequence
  KARI variant 76406
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRKNNAAHGIEIIGEQLRAMMPWIGANKIVDKRKN

SEQ ID NO: 129 - protein, 338 aa, Artificial sequence
  KARI variant 76407
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRTAMRNALKRIQDGEFAKMFISEGATGYPSMTAKRRNNAAHGIEIIGEQLRSMMPWIGRNKIVDKRKN

SEQ ID NO: 130 - protein, 338 aa, Artificial sequence
  KARI variant 76408
MKVFYDKDCDLSIIQGKKVAIIGFGSQGHAQALNLKDSGVDVTVGLPKGFADVAKAEAHGFKVTDVAAKVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 131 - protein, 338 aa, Artificial sequence
  KARI variant 76409
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYSQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGVTGYPSMTAKRRNNAAHGIEIIGEQLRSMMPWIGANKIVDKRKN

SEQ ID NO: 132 - protein, 338 aa, Artificial sequence
  KARI variant 76410
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIACYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 133 - protein, 338 aa, Artificial sequence
  KARI variant 76411
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYSQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKHIQDGEFAKMFISEGATGYPSMTAKRRNNAAHGIEIIGEQLRSMMPWIGANKIVDKRKN

SEQ ID NO: 134 - protein, 338 aa, Artificial sequence
  KARI variant 76412
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFNSEGATGYPSMTAKRRNNAAHGIEIIGEQLRSMMPWIGANKIVDKRKN

SEQ ID NO: 135 - protein, 338 aa, Artificial sequence
  KARI variant 76413
MKVFYDKDCDLSIIQGKKVAIIGFGSQGHAQALNLKDSGVDVTVGLPKGFADVAKAEAHGFKVTDVAAKVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDMRKN

SEQ ID NO: 136 - protein, 338 aa, Artificial sequence
  KARI variant 76414
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKLIQDGEFAKMFISEGATGYPSMTAKRRNNAAHGIEIIGEQLRSMMPWIGANKIVDKRKN

SEQ ID NO: 137 - protein, 338 aa, Artificial sequence
  KARI variant 76415
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRSMMPWIGANKIVDKRKN

SEQ ID NO: 138 - protein, 338 aa, Artificial sequence
  KARI variant 76416
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 139 - protein, 338 aa, Artificial sequence
  KARI variant 76417
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPKVINAESRQAMRNALKDIQDGEFAKMFISEGVTGYPSMTAKRRNNAAHGIEIIGEQLRSMMPWIGANKIVDKRKN

SEQ ID NO: 140 - protein, 338 aa, Artificial sequence
  KARI variant 76418
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDMRKN

SEQ ID NO: 141 - protein, 338 aa, Artificial sequence
  KARI variant 76419
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVTGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 142 - protein, 338 aa, Artificial sequence
  KARI variant 76420
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRTAMRNALKRIQDGEFAKMFISEGATGYPSMTAKRKNNAAHGIEIIGEQLRSMMPWIGANKIVDKRKN

SEQ ID NO: 143 - protein, 338 aa, Artificial sequence
  KARI variant 76421
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKLIQDGEFAKMFISEGATGYPSMTAKRRNNAAHGIEIIGEQLRAMMPWIGANKIVDKRKN

SEQ ID NO: 144 - protein, 338 aa, Artificial sequence
  KARI variant 76422
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGRNKIVDKRKN

SEQ ID NO: 145 - protein, 338 aa, Artificial sequence
  KARI variant 76423
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYSQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFNSEGATGYPSMTAKRRNNAAHGIEIIGEQLRSMMPWIGANKIVDKRKN

SEQ ID NO: 146 - protein, 338 aa, Artificial sequence
  KARI variant 76424
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPKVINAESRQAMRNALKDIQDGEFAKMFISEGATGYPSITAKRRNNAAHGIEIIGEQLRSMMPWIGANKIVDKRKN

SEQ ID NO: 147 - protein, 338 aa, Artificial sequence
  KARI variant 76425
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRSMMPWIGANKIVDKRKN

SEQ ID NO: 148 - protein, 338 aa, Artificial sequence
  KARI variant 76426
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKHIQDGEFAKMFISEGVTGYPSMTAKRRNNAAHGIEIIGEQLRSMMPWIGANKIVDKRKN

SEQ ID NO: 149 - protein, 338 aa, Artificial sequence
  KARI variant 76427
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIACYQDVTGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 150 - protein, 338 aa, Artificial sequence
  KARI variant 76428
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVTGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFNSEGATGYPSMTAKRRNNAAHGIEIIGEQLRSMMPWIGANKIVDKRKN

SEQ ID NO: 151 - protein, 338 aa, Artificial sequence
  KARI variant 76429
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 152 - protein, 338 aa, Artificial sequence
  KARI variant 76430
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRTAMRNALKRIQDGEFAKMFISEGATGYPSMTAKRRNNAAHGIEIIGEQLRSMMPWIGANKIVDMRKN

SEQ ID NO: 153 - protein, 338 aa, Artificial sequence
  KARI variant 76431
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIACYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 154 - protein, 338 aa, Artificial sequence
  KARI variant 76432
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 155 - protein, 338 aa, Artificial sequence
  KARI variant 76433
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPKVINAESRQAMRNALKDIQDGEFAKMFISEGATGYPSMTAKRRNNAAHGIEIIGEQLRSMMPWIGRNKIVDMRKN

SEQ ID NO: 156 - protein, 338 aa, Artificial sequence
  KARI variant 76434
MKVFYDKDCDLSIIQGKKVAIIGFGSQGHAQALNLKDSGVDVTVGLPKGFADVAKAEAHGFKVTDVAAKVAGADLVMILIPDEFQSQLYKNEIEPNIKKGATLAFSHGFAIHYNQVVPRADLDVIMIAPKAPGHTVRSEFVKGGGIPDLIACYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKHIQDGEFAKMFISEGATGYPSMTAKRRNNAAHGIEIIGEQLRSMMPWIGANKIVDKRKN

SEQ ID NO: 157 - protein, 338 aa, Artificial sequence
  KARI variant 76435
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYSQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRSMMPWIGENKIVDKRKN

SEQ ID NO: 158 - protein, 338 aa, Artificial sequence
  KARI variant 76436
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRTAMRNALKRIQDGEWAKMFISEGVTGYPSMTAKRRNNAAHGIEIIGEQLRSMMPWIGANKIVDKRKN

SEQ ID NO: 159 - protein, 338 aa, Artificial sequence
  KARI variant 76437
MKVFYDKDCDLSIIQGKKVAIIGFGSQGHAQALNLKDSGVDVTVGLPKGFADVAKAEAHGFKVTDVAAAVAWADLVMILIPDEFQSQLYKNEIEPNIKKGATLAFSHGFAIHYGQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 160 - protein, 338 aa, Artificial sequence
  KARI variant 76438
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKLIQDGEFAKMFISEGATGYPSMTAKRKNNAAHGIEIIGEQLRAMMPWIGANKIVDKRKN

SEQ ID NO: 161 - protein, 338 aa, Artificial sequence
  KARI variant 76439
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVTGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFNSEGATGYPSMTAKRRNNAAHGIEIIGEQLRSMMPWIGANKIVDKRKN

SEQ ID NO: 162 - DNA, 9586 bp, Artificial sequence
  Plasmid pLH556 (pHR81-PIlv5-Pf5.KARI)
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaactaaggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggc

SEQ ID NO: 163 - DNA, 12896 bp, Artificial sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 164 - DNA, 12319 bp, Artificial sequence
  pBP2090 (pHR81-PIlv5p.K9D3.TEF1(M4)p.ilvD)
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 165 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 166 - protein, 559 aa, K. pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 167 - protein, 570 aa, Lactococcus lactis
MEFKYNGKVESVELNKYSKTLTPRSTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFEALGQKITGNISDEDYHGVICNAIPGQGACGGMYTANTLAAAIETLGMSLPYSSSNPAVSQEKQEECDDIGLAIKNLLEKDIKPSDIMTKEAFENAITIVMVLGGSTNAVLHIIAMANAIGVEITQDDFQRISDIIPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSNEEIAKRRANYQKPTPKATRGVLAKFAKLTRPASEGCVTDL

SEQ ID NO: 168 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 170 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 171 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

SEQ ID NO: 172 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 173 - protein, 347 aa, Beijerinckia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 174 - DNA, 804 bp, Artificial Sequence
  YMR226C
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 175 - protein, 267 aa, Artificial Sequence
  YMR226C
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 176 - DNA, 1410 bp, Artificial Sequence
  YIL074C (Chr 9)
atgtcttattcagctgccgataatttacaagattcattccaacgtgccatgaacttttctggctctcctggtgcagtctcaacctcaccaactcagtcatttatgaacacactacctcgtcgtgtaagcattacaaagcaaccaaaggctttaaaacctttttctactggtgacatgaatattctactgttggaaaatgtcaatgcaactgcaatcaaaatcttcaaggatcagggttaccaagtagagttccacaagtcttctctacctgaggatgaattgattgaaaaaatcaaagacgtacacgctatcggtataagatccaaaactagattgactgaaaaaatactacagcatgccaggaatctagtttgtattggttgtttttgcataggtaccaatcaagtagacctaaaatatgccgctagtaaaggtattgctgttttcaattcgccattctccaattcaagatccgtagcagaattggtaattggtgagatcattagtttagcaagacaattaggtgatagatccattgaactgcatacaggtacatggaataaagtcgctgctaggtgttgggaagtaagaggaaaaactctcggtattattgggtatggtcacattggttcgcaattatcagttcttgcagaagctatgggcctgcatgtgctatactatgatatcgtgacaattatggccttaggtactgccagacaagtttctacattagatgaattgttgaataaatctgattttgtaacactacatgtaccagctactccagaaactgaaaaaatgttatctgctccacaattcgctgctatgaaggacggggcttatgttattaatgcctcaagaggtactgtcgtggacattccatctctgatccaagccgtcaaggccaacaaaattgcaggtgctgctttagatgtttatccacatgaaccagctaagaacggtgaaggttcatttaacgatgaacttaacagctggacttctgagttggtttcattaccaaatataatcctgacaccacatattggtggctctacagaagaagctcaaagttcaatcggtattgaggtggctactgcattgtccaaatacatcaatgaaggtaactctgtcggttctgtgaacttcccagaagtcagtttgaagtctttggactacgatcaagagaacacagtacgtgtcttgtatattcatcgtaacgttcctggtgttttgaagaccgttaatgatatcttatccgatcataatatcgagaaacagttttctgattctcacggcgagatcgcttatctaatggcagacatctcttctgttaatcaaagtgaaatcaaggatatatatgaaaagttgaaccaaacttctgccaaagtttccatcaggttattatactaa

SEQ ID NO: 177 - protein, 469 aa, Artificial Sequence
  YIL074C (Chr 9)
MSYSAADNLQDSFQRAMNFSGSPGAVSTSPTQSFMNTLPRRVSITKQPKALKPFSTGDMNILLLENVNATAIKIFKDQGYQVEFHKSSLPEDELIEKIKDVHAIGIRSKTRLTEKILQHARNLVCIGCFCIGTNQVDLKYAASKGIAVFNSPFSNSRSVAELVIGEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVSLKSLDYDQENTVRVLYIHRNVPGVLKTVNDILSDHNIEKQFSDSHGEIAYLMADISSVNQSEIKDIYEKLNQTSAKVSIRLLY

SEQ ID NO: 178 - DNA, 792 bp, Artificial Sequence
  YIR036C (Chr 9)
atgggcaaggttattttgattacaggtgcctcccgtgggattggcctgcaattggtgaaaactgttatcgaagaggacgatgaatgcatcgtctacggcgtagcaagaacggaagctggtctgcagtctttgcaaagagaatacggtgcagacaaatttgtctatcgtgtcctcgacatcacggacaggtctcgaatggaagcgttggtggaggaaatccggcaaaagcatggaaaactggacggtattgtcgcaaatgcggggatgctagaaccggtgaagtccatctcccagtccaactccgaacacgacatcaagcagtgggaacggctgttcgatgtgaactttttcagcattgtctctttggtggcactgtgtttacccctcttgaagagctcgccatttgtaggcaacattgtcttcgtcagctctggagccagtgtgaaaccatataacggatggtcggcgtacggctgctcgaaagccgcattaaaccactttgccatggacattgccagtgaagagcccagtgataaagtgcgtgccgtgtgtattgcaccgggcgtcgttgacacgcagatgcagaaagatattagggaaacattgggtcctcagggcatgacacccaaggctctcgagaggtttactcaattgtacaagacttcgtcactgctggacccaaaggtgcctgcggcggtactagcgcaactcgtcctgaaaggtattcccgactctttgaacggtcaatatctccgctacaacgatgagcgactggggccggtgcagggctag

SEQ ID NO: 179 - protein, 263 aa, Artificial Sequence
  YIR036C (Chr 9)
MGKVILITGASRGIGLQLVKTVIEEDDECIVYGVARTEAGLQSLQREYGADKFVYRVLDITDRSRMEALVEEIRQKHGKLDGIVANAGMLEPVKSISQSNSEHDIKQWERLFDVNFFSIVSLVALCLPLLKSSPFVGNIVFVSSGASVKPYNGWSAYGCSKAALNHFAMDIASEEPSDKVRAVCIAPGVVDTQMQKDIRETLGPQGMTPKALERFTQLYKTSSLLDPKVPAAVLAQLVLKGIPDSLNGQYLRYNDERLGPVQG

SEQ ID NO: 180 - DNA, 1503 bp, Artificial Sequence
  YPL061W (ALD6)(Chr 16)
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 181 - protein, 500 aa, Artificial Sequence
  YPL061W (ALD6)(Chr 16)
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 182 - DNA, 1029 bp, Artificial Sequence
  YPL088W (Chr 16)
atggttttagttaagcaggtaagactcggtaactcaggtcttaagatatcaccgatagtgataggatgtatgtcatacgggtccaagaaatgggcggactgggtcatagaggacaagacccaaattttcaagattatgaagcattgttacgataaaggtcttcgtacttttgacacagcagatttttattctaatggtttgagtgaaagaataattaaggagtttctggagtactacagtataaagagagaaacggtggtgattatgaccaaaatttacttcccagttgatgaaacgcttgatttgcatcataacttcactttaaatgaatttgaagaattggacttgtccaaccagcggggtttatccagaaagcatataattgctggtgtcgagaactctgtgaaaagactgggcacatatatagaccttttacaaattcacagattagatcatgaaacgccaatgaaagagatcatgaaggcattgaatgatgttgttgaagcgggccacgttagatacattggggcttcgagtatgttggcaactgaatttgcagaactgcagttcacagccgataaatatggctggtttcagttcatttcttcgcagtcttactacaatttgctctatcgtgaagatgaacgcgaattgattccttttgccaaaagacacaatattggtttacttccatggtctcctaacgcacgaggcatgttgactcgtcctctgaaccaaagcacggacaggattaagagtgatccaactttcaagtcgttacatttggataatctcgaagaagaacaaaaggaaattataaatcgtgtggaaaaggtgtcgaaggacaaaaaagtctcgatggctatgctctccattgcatgggttttgcataaaggatgtcaccctattgtgggattgaacactacagcaagagtagacgaagcgattgccgcactacaagtaactctaacagaagaagagataaagtacctcgaggagccctacaaaccccagaggcaaagatgttaa

SEQ ID NO: 183 - protein, 342 aa, Artificial Sequence
  YPL088W(Chr 16)
MVLVKQVRLGNSGLKISPIVIGCMSYGSKKWADWVIEDKTQIFKIMKHCYDKGLRTFDTADFYSNGLSERIIKEFLEYYSIKRETVVIMTKIYFPVDETLDLHHNFTLNEFEELDLSNQRGLSRKHIIAGVENSVKRLGTYIDLLQIHRLDHETPMKEIMKALNDVVEAGHVRYIGASSMLATEFAELQFTADKYGWFQFISSQSYYNLLYREDERELIPFAKRHNIGLLPWSPNARGMLTRPLNQSTDRIKSDPTFKSLHLDNLEEEQKEIINRVEKVSKDKKVSMAMLSIAWVLHKGCHPIVGLNTTARVDEAIAALQVTLTEEEIKYLEEPYKPQRQRC

SEQ ID NO: 184 - DNA, 1086 bp, Artificial Sequence
  YCR105W  (ADH7)(Chr 3)
atgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatag

SEQ ID NO: 185 - protein, 361 aa, Artificial Sequence
  YCR105W  (ADH7)(Chr 3)
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 186 - DNA, 1035 bp, Artificial Sequence
  YDR541C (Chr 4)
atgtctaatacagttctagtttctggcgcttcaggttttattgccttgcatatcctgtcacaattgttaaaacaagattataaggttattggaactgtgagatcccatgaaaaagaagcaaaattgctaagacaatttcaacataaccctaatttaactttagaaattgttccggacatttctcatccaaatgctttcgataaggttctgcagaaacgtggacgtgagattaggtatgttctacacacggcctctccttttcattatgatactaccgaatatgaaaaagacttattgattcccgcgttagaaggtacaaaaaacatcctaaattctatcaagaaatatgcagcagacactgtagagcgtgttgttgtgacttcttcttgtactgctattataacccttgcaaagatggacgatcccagtgtggtttttacagaagagagttggaacgaagcaacctgggaaagctgtcaaattgatgggataaatgcttactttgcatccaagaagtttgctgaaaaggctgcctgggagttcacaaaagagaatgaagatcacatcaaattcaaactaacaacagtcaacccttctcttctttttggtcctcaacttttcgatgaagatgtgcatggccatttgaatacttcttgcgaaatgatcaatggcctaattcataccccagtaaatgccagtgttcctgattttcattccatttttattgatgtaagggatgtggccctagctcatctgtatgctttccagaaggaaaataccgcgggtaaaagattagtggtaactaacggtaaatttggaaaccaagatatcctggatattttgaacgaagattttccacaattaagaggtctcattcctttgggtaagcctggcacaggtgatcaagtcattgaccgcggttcaactacagataatagtgcaacgaggaaaatacttggctttgagttcagaagtttacacgaaagtgtccatgatactgctgcccaaattttgaagaagcagaacagattatga

SEQ ID NO: 187 - protein, 344 aa, Artificial Sequence
  YDR541C (Chr 4)
MSNTVLVSGASGFIALHILSQLLKQDYKVIGTVRSHEKEAKLLRQFQHNPNLTLEIVPDISHPNAFDKVLQKRGREIRYVLHTASPFHYDTTEYEKDLLIPALEGTKNILNSIKKYAADTVERVVVTSSCTAIITLAKMDDPSVVFTEESWNEATWESCQIDGINAYFASKKFAEKAAWEFTKENEDHIKFKLTTVNPSLLFGPQLFDEDVHGHLNTSCEMINGLIHTPVNASVPDFHSIFIDVRDVALAHLYAFQKENTAGKRLVVTNGKFGNQDILDILNEDFPQLRGLIPLGKPGTGDQVIDRGSTTDNSATRKILGFEFRSLHESVHDTAAQILKKQNRL

SEQ ID NO: 188 - DNA, 1410 bp, Artificial Sequence
  YER081 (SER3)(Chr 5)
atgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactattagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtatcggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaa

SEQ ID NO: 189 - protein, 469 aa, Artificial Sequence
  YER081 (SER3)(Chr 5)
MTSIDINNLQNTFQQAMNMSGSPGAVCTSPTQSFMNTVPQRLNAVKHPKILKPFSTGDMKILLLENVNQTAITIFEEQGYQVEFYKSSLPEEELIEKIKDVHAIGIRSKTRLTSNVLQHAKNLVCIGCFCIGTNQVDLDYATSRGIAVFNSPFSNSRSVAELVIAEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVALKSLSYDQENTVRVLYIHQNVPGVLKTVNDILSNHNIEKQFSDSNGEIAYLMADISSVDQSDIKDIYEQLNQTSAKISIRLLY

SEQ ID NO: 190 - DNA, 711 bp, Artificial Sequence
  YPL275W  (FDH2)(Chr 16)
atggtggtcatcaataagcaattaatggtgagtgggatattgccggcgtggctaaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctgcatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 191 - protein, 236 aa, Artificial Sequence
  YPL275W  (FDH2)(Chr 16)
MVVINKQLMVSGILPAWLKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLHAQKRYAQGVKNILNSYFSKKFDYRPQDIIVQNGSYATRAYGQKK

SEQ ID NO: 192 - DNA, 1494 bp, Artificial Sequence
  YBR006W (UGA5)(Chr2)
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctggcaaccatcattactttagaaaatggtaaagctctaggggaagctaaaggagaaatcaaatacgcggcttcgtattttgagtggtacgccgaggaagcaccccgtttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacactttatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaa

SEQ ID NO: 193 - protein, 497 aa, Artificial Sequence
  YBR006W (UGA5)(Chr2)
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 194 - DNA, 1323 bp, Artificial Sequence
  YOL059W (Chr 15)
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 195 - protein, 440 aa, Artificial Sequence
  YOL059W (Chr 15)
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 196 - DNA, 1410 bp, Artificial sequence; identical to SEQ ID NO: 188
  YER081W  Chr 5

SEQ ID NO: 197 - protein, 469 aa, Artificial Sequence; identical to SEQ ID NO: 189
  YER081W  Chr 5

SEQ ID NO: 198 - DNA, 1365 bp, Artificial Sequence
  YOR375C  Chr 15
atgtcagagccagaatttcaacaagcttacgaagaagttgtctcctctttggaagactctactcttttcgaacaacacccagaatacagaaaggttttgccaattgtttctgttccagaaagaatcatacaattcagagtcacctgggaaaatgacaagggtgaacaagaagttgctcaaggttacagagtgcaatataactccgccaagggtccatacaagggtggtctacgtttccatccttccgtgaacttgtctatcttgaaattcttgggtttcgaacaaatcttcaagaactccttgaccggcctagacatgggtggtggtaaaggtggtctatgtgtggacttgaagggaagatctaataacgaaatcagaagaatctgttatgctttcatgagagaattgagcagacacattggtcaagacactgacgtgccagctggtgatatcggtgttggtggtcgtgaaattggttacctgttcggtgcttacagatcatacaagaactcctgggaaggtgtcttaaccggtaagggtttgaactggggtggttctttgatcagaccagaagccactggttacggtttagtttactatactcaagctatgatcgactatgccacaaacggtaaggaatctttcgaaggtaagcgcgtcaccatctctggtagtggtaacgttgctcaatacgctgccttgaaggttattgagctaggtggtactgtcgtttccctatctgactccaagggttgtatcatctctgaaactggtatcacctccgaacaagtcgctgatatttccagtgctaaggtcaacttcaagtccttggaacaaatcgtcaacgaatactctactttctccgaaaacaaagtgcaatacattgctggtgctcgtccatggacccacgtccaaaaggtcgacattgctttgccatgtgccacccaaaatgaagtcagcggtgaagaagccaaggccttggttgctcaaggtgtcaagtttattgccgaaggttccaacatgggttccactccagaagctattgccgtctttgaaactgctcgttccaccgccactggaccaagcgaagctgtttggtacggtccaccaaaggctgctaacttgggtggtgttgctgtttctggtttagaaatggcacaaaactctcaaagaatcacatggactagcgaaagagttgaccaagagttgaagagaattatgatcaactgtttcaatgaatgtatcgactatgccaagaagtacactaaggacggtaaggtcttgccatctttggtcaaaggtgctaatatcgcaagtttcatcaaggtctctgatgctatgtttgaccaaggtgatgtattttaa

SEQ ID NO: 199 - protein, 454 aa, Artificial Sequence
  YOR375C  Chr 15   reverse complement
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 200 - DNA, 804 bp, Saccharomyces paradoxus
atgtcccaaggtagaaaagctgcagaaagattggctaacaagaccgtgctcattacgggtgcctctgctggtattggtaaggccaccgcattagagtatttggaggcatccaatggtgatatgaaactggtcttagctgctagaagattagaaaagctcgaggaattaaagaaaactattgatcaggagtttccaaacgccaaagttcatgtggcccaactggatatcactcaagcagaaaagatcaagccctttattgagaatttgccaaaggagttcaaagacattgacattttggtgaacaacgctgggaaggcccttggtaccgaccgtgtgggggagattgcaacacaagatatccaggatgtgtttgacaccaacgtcacagctttaattaatatcactcaagctgtgctgcccatttttcaagccaagaactcaggggatattgtgaacttgggttcggtggctggcagggatgcatacccaacgggttccatctattgtgcctccaagtttgccgtgggggcgttcactgatagtttaagaaaggagcttatcaacaccaagatcagagtcatcctaatcgcaccagggctagtcgaaactgaattttcactggttagatacagaggcaacgaggagcaagccaagaatgtctacaaggacaccaccccattaatggctgatgacgtggctgatttgatcgtgtacgcaacttccaggaaacaaaacactgtaattgcagacacgctaatctttccaaccaaccaagcatcgcctcaccacatcttccgtggatga

SEQ ID NO: 201 - protein, 267 aa, Saccharomyces paradoxus
MSQGRKAAERLANKTVLITGASAGIGKATALEYLEASNGDMKLVLAARRLEKLEELKKTIDQEFPNAKVHVAQLDITQAEKIKPFIENLPKEFKDIDILVNNAGKALGTDRVGEIATQDIQDVFDTNVTALINITQAVLPIFQAKNSGDIVNLGSVAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 202 - DNA, 805 bp, Saccharomyces bayanus
atgtcccaaggtagaaaagctgcagaaagattggccaacaagacggtgctcattacaggcgcttctgctggtattggtaaggccaccgcattggagtatttggaagcatccaatggaaacatgaaactgatcttggctgcgaggagattggagaagctagaggagctgaagaagaccatcgacgaggagtttcccaatgcaaaggttcacgttggccaactggatatcacacaggccgagaagatcaagcccttcattgaaaacttgccggaggcattcaaggatattgacatcctgataaacaatgccggcaaagccctgggctccgaacgtgtcggggaaattgccacacaggacatccaggacgtgttcgacaccaacgtcacggcgttgatcaacgtcacgcaagcagtgctgccaattttccaagccaagaactcaggggacatcgtcaacttggggctcggtggccggcagagacgcataccccacaggctccatctactgtgcttccaagtttgccgtcggtgcgttcactgacagtttgagaaaggaactgatcaacacgaagatcagagttatcttgatcgcgccggggctggttgagaccgagttctcactggtcagatacagaggtaatgaggaacaagctaaaaacgtctacaaggacactacgccgttgatggccgacgacgtggctgacttaatcgtatattccacttccagaaagcagaacaccgtggttgccgacaccctgatcttccccaccaaccaagcctcgccctaccacatctttcgcggttaa

SEQ ID NO: 203 - protein, 262 aa, Saccharomyces bayanus
MSQGRKAAERLANKTVLITGASAGIGKATALEYLEASNGNMKLILAARRLEKLEELKKTIDEEFPNAKVHVGQLDITQAEKIKPFIENLPEAFKDIDILINNAGKALGSERVGEIATQDIQDVFDTNVTALINVTQAVLPIFQAKNSGDIVNLGLGGRQRRIPHRLHLLCFQVCRRCVHQFEKGTDQHEDQSYLDRAGAGDRVLTGQIQRGTSKRLQGHYAVDGRRRGLNRIFHFQKAEHRGCRHPDLPHQPSLALPHLSRL

SEQ ID NO: 204 - DNA, 804 bp, Saccharomyces castellii
atgtctcaaggtcctaaagctgccgaaagattgaatgagaagattgtgtttatcactggtgcttcagctggtattgggcaagccaccgctttggaatacatggatgcgtcgaacggtactgtgaaattggttctagttgccagaagattggagaaattacaacaattgaaggaagtcattgaggcaaaataccctaagagtaaagtctatattgggaagttggatgtgacagagcttgagaccattcaaccattcttggataatcttcctgaggaatttaaggatattgatatcttgattaataatgccgggaaggcattaggttccgatcgtgtaggtgatattgatataaaagatgtgaagggaatgatggataccaatgtcttggggttgatcaatgtgacgcaagctgtgttgcacattttccaaaagaagaactccggtgatattgtgaacttaggttcagttgctggaagagatgcatacccaacagggtccatttactgtgcttctaaatttgccgtgagggcctttactgaaagtttgagaagggaattaattaataccaagattagggtgatattgatagccccgggtatcgtcgaaactgaattctcagttgttagatacaagggtgataatgagcgtgctaaatctgtctacgatggagttcaccccttggaagcagacgacgtagcagatttaattgtatacaccacttcaagaaaacagaacacagtaattgctgacactttgatattcccaacctctcaaggttccgcattccacgtccatcgcgattaa

SEQ ID NO: 205 - protein, 267 aa, Saccharomyces castellii
MSQGPKAAERLNEKIVFITGASAGIGQATALEYMDASNGTVKLVLVARRLEKLQQLKEVIEAKYPKSKVYIGKLDVTELETIQPFLDNLPEEFKDIDILINNAGKALGSDRVGDIDIKDVKGMMDTNVLGLINVTQAVLHIFQKKNSGDIVNLGSVAGRDAYPTGSIYCASKFAVRAFTESLRRELINTKIRVILIAPGIVETEFSVVRYKGDNERAKSVYDGVHPLEADDVADLIVYTTSRKQNTVIADTLIFPTSQGSAFHVHRD

SEQ ID NO: 206 - DNA, 804 bp, Saccharomyces mikatae
atgtctcaaggtagaaaagctgcagaaagattggctggcaaaaccgttctcatcacgggtgcctctgctggtattggcaaagccactgcattagagtatttggaggcatccaatggcgatatgaaattaatcttagccgctagaagattagaaaagctcgaggaattgaagaagactatcgatgaagagtttccaaacgcaaaggtccatgtgaccaaactggacatcacacagacagaaaagatcaagccctttattgaaaacttgccagaggagttcaaagacattgatattctggtgaacaacgctggtaaggctcttggtacggaccgtgttggggagattgatacacaggacgtccaggacgtgttcgacaccaacgtctcggctttgattaatgtcacacaggctgttctgcccatcttccaagctaagaactcaggggatattgtgaacttgggctcggtagctggcagagatgcatacccaacgggctccatctattgtgcatctaagtttgccgtcggggctttcactgagagtttgagaatggaacttataaacactaagattagagtcattctaattgcaccagggttagtcgaaactgagttttccctggttagatacagaggtaacgaagaacaagccaagaatgtttacaaggacaccactccgttgatggccgatgacgtggctgatttgattgtgtatgcgacttcaaggaagcagaacactgtaattgcagacacactaatctttcctaccaaccaagcgtcaccttaccatatctttcgcgggtga

SEQ ID NO: 207 - protein, 267 aa, Saccharomyces mikatae
MSQGRKAAERLAGKTVLITGASAGIGKATALEYLEASNGDMKLILAARRLEKLEELKKTIDEEFPNAKVHVTKLDITQTEKIKPFIENLPEEFKDIDILVNNAGKALGTDRVGEIDTQDVQDVFDTNVSALINVTQAVLPIFQAKNSGDIVNLGSVAGRDAYPTGSIYCASKFAVGAFTESLRMELINTKIRVILIAPGLVETEFSLVRYRGNEEQAKNVYKDTTPLMADDVADLIVYATSRKQNTVIADTLIFPTNQASPYHIFRG

SEQ ID NO: 208 - DNA, 804 bp, Ashbya gossypii
atgtccctaggaagaaaagcagctgaaagattagccaacaaaattgtgcttgtgactggtgcctctgcgggcattggccgtgctacagccattaactatgcagacgcgacggacggggcaatcaagttgattttggtggcaagacgcgcagaaaagctcaccagcttgaaacaggagatcgaaagcaagtatcccaacgccaagatccatgtcggacaattggatgtgacccaactggaccagatccgcccatttttggagggactacctgaggagttccgagacattgatattttaattaacaacgcaggtaaggccctcggcactgagagggtgggggaaatctcgatggacgatatccaggaggttttcaacactaatgttatcggcttggtgcacttgactcaggaggttctacctattatgaaagccaagaattccggggacattgtcaatgttgggtcgattgccggccgcgaagcctaccctggtggctctatttactgtgccacgaaacatgcggtcaaggctttcaccagggccatgcggaaggagctcattagcaccaagatccgggtcttcgaaattgcgccgggctctgtagaaacggaattctccatggttcgtatgcgcggtaacgaagagaatgccaagaaagtgtaccagggatttgaacccctagatggtgatgatatcgctgatacaattgtctatgccacatccagaagatccaacaccgtagttgcagagatggtcgtttacccatccgcgcaaggttctctgtacgatactcaccgcaactaa

SEQ ID NO: 209 - protein, 267 aa, Ashbya gossypii
MSLGRKAAERLANKIVLVTGASAGIGRATAINYADATDGAIKLILVARRAEKLTSLKQEIESKYPNAKIHVGQLDVTQLDQIRPFLEGLPEEFRDIDILINNAGKALGTERVGEISMDDIQEVFNTNVIGLVHLTQEVLPIMKAKNSGDIVNVGSIAGREAYPGGSIYCATKHAVKAFTRAMRKELISTKIRVFEIAPGSVETEFSMVRMRGNEENAKKVYQGFEPLDGDDIADTIVYATSRRSNTVVAEMVVYPSAQGSLYDTHRN

SEQ ID NO: 210 - DNA, 807 bp, Candida glabrata
atgtctcaaggaagaaaagctgctgagaggttacaagggaagattgcctttattacgggtgcctctgcgggcatcggtaaagctacagccattgagtatttggatgcttccaatggtagtgtgaagctagttcttggtgcacgtagaatggagaaattggaggagttgaagaaggaattgctggctcaatatcctgatgcaaagattcatataggtaaactggatgttacagactttgaaaacgtcaagcagtttttggctgacttgccagaagagttcaaggacatcgacatcctgatcaataacgctggtaaagcgttggggtctgacaaagttggagacattgaccctgaggatatcgcaggaatggttaacaccaacgtccttgcattgatcaatttaacacaattgttgttgccattattcaagaagaagaacagtggtgatatcgtcaacttgggatcgattgctggtagagacgcatacccaacgggtgctatatactgtgcaacaaaacatgctgtcagggcattcacacaatccttaaggaaggaattgatcaacaccgacattagagtaattgaaattgctcctggtatggtcgaaaccgagttttctgtggtcaggtacaaaggtgacaagtccaaagcagacgacgtctacagaggtacaacaccactatatgccgatgatatcgcggatttgattgtgtactctaccagcagaaagccaaacatggtggtagcagatgtcctggtcttcccaacacaccaggcatcggcttcgcacatctacaggggcgactaa

SEQ ID NO: 211 - protein, 268 aa, Candida glabrata
MSQGRKAAERLQGKIAFITGASAGIGKATAIEYLDASNGSVKLVLGARRMEKLEELKKELLAQYPDAKIHIGKLDVTDFENVKQFLADLPEEFKDIDILINNAGKALGSDKVGDIDPEDIAGMVNTNVLALINLTQLLLPLFKKKNSGDIVNLGSIAGRDAYPTGAIYCATKHAVRAFTQSLRKELINTDIRVIEIAPGMVETEFSVVRYKGDKSKADDVYRGTTPLYADDIADLIVYSTSRKPNMVVADVLVFPTHQASASHIYRGD

SEQ ID NO: 212 - DNA, 813 bp, Debaryomyces hansenii
atgtcgtacggatctaaagctgctgaacgtgttgccaataagattgtcttaatcactggtgcttcatctggaattggtgaagcaactgccaaagaaattgcatcagccgctaatggcaatttaaaattagtgttgtgtgctagacgaaaagaaaagttggataatttatctaaagaattgactgacaaatattcatccatcaaggttcatgttgctcaactagatgtatctaagctcgagactatcaagccatttatcaatgatttaccgaaagaattctctgacgtggatgtattagtcaacaatgcaggcttggctttgggccgtgatgaagttggaaccattgacacagatgatatgttatcgatgtttcaaactaatgttttagggttaattaccatcacacaggctgttttgccaatcatgaaaaagaagaacagcggagatgttgttaatataggttcaattgctggaagagactcttaccctggaggtggaatttactgtccaactaaggcaagtgtcaagtcgttttcgcaagttttaagaaaggaattgattagcaccaagattagagttcttgaggttgaccctggtaatgttgaaactgaattttcaaatgtcagattcaagggcgatatggaaaaggcaaagctggtttacgcgggtactgaaccattattatccgaagacgtagctgaggttgtcgtattcggacttacaagaaagcaaaataccgttattgctgagacattagtcttttcaaccaatcaagccagctcatctcacttataccgtgaaagcgataaataa

SEQ ID NO: 213 - protein, 270 aa, Debaryomyces hansenii
MSYGSKAAERVANKIVLITGASSGIGEATAKEIASAANGNLKLVLCARRKEKLDNLSKELTDKYSSIKVHVAQLDVSKLETIKPFINDLPKEFSDVDVLVNNAGLALGRDEVGTIDTDDMLSMFQTNVLGLITITQAVLPIMKKKNSGDVVNIGSIAGRDSYPGGGIYCPTKASVKSFSQVLRKELISTKIRVLEVDPGNVETEFSNVRFKGDMEKAKLVYAGTEPLLSEDVAEVVVFGLTRKQNTVIAETLVFSTNQASSSHLYRESDK

SEQ ID NO: 214 - DNA, 810 bp, Scheffersomyces stipitis
atgtcgtttggaaaaaaagctgctgaaagacttgccaacaaaatcattcttatcaccggggcttcgtctggtattggtgaagctacagctagagagtttgcatctgctgccaatgggaatatcagattgattttgacagccagaagaaaagaaaagttggctcaattgtcagactcattgaccaaggaatttccaactatcaaaatccattctgccaaattggatgtgaccgaacatgatggcatcaagcctttcatttctggtttacccaaggatttcgccgacatcgatgtgttgatcaacaatgctggaaaagctcttggaaaagcatctgttggtgaaatcagtgacagtgatatccaaggcatgatgcaaacgaatgtcttgggactcatcaacatgactcaggctgtgattcccatttttaaggctaaaaattctggagatatcgtcaacatcggttcgattgctggaagagacccttaccctggtggatcgatctactgtgcctccaaggctgctgttaagttcttctcgcattctttgagaaaggaactcattaacaccagaatcagagttttggaagttgatccaggtgctgtgttgaccgagttctctttggttcgtttccacggtgatcagggagctgctgatgctgtttatgaaggtacccaacctttggatgcctctgatatcgcagaagttatcgtgtttggtatcaccagaaagcagaacaccgtcatagccgaaaccttggtattcccaagtcaccaggcttctgcctctcatgtttacaaggctcctaagtag

SEQ ID NO: 215 - protein, 269 aa, Scheffersomyces stipitis
MSFGKKAAERLANKIILITGASSGIGEATAREFASAANGNIRLILTARRKEKLAQLSDSLTKEFPTIKIHSAKLDVTEHDGIKPFISGLPKDFADIDVLINNAGKALGKASVGEISDSDIQGMMQTNVLGLINMTQAVIPIFKAKNSGDIVNIGSIAGRDPYPGGSIYCASKAAVKFFSHSLRKELINTRIRVLEVDPGAVLTEFSLVRFHGDQGAADAVYEGTQPLDASDIAEVIVFGITRKQNTVIAETLVFPSHQASASHVYKAPK

SEQ ID NO: 216 - DNA, 891 bp, Meyerozyma guilliermondii
atgtgcctcttaccagccggtagcactgtattatgtcatcacccagtagtgagtgtggagattaaatcctcaatcttcatgtctttcggtgccaaagccgctgaacgccttgccaacaagatcatattgatcactggggcatcgtctggtataggcgaggctaccgccagagaattcgctgctgctgccaatggaaaaattctgttgattttgaccgctcggagagaagacaaactcaagtctctctcgcaacaattgagcctcatttacccgcaaattaaaatccattctgctcgtcttgatgtctctgagttttcgtcacttaagccgttcattactgggttgccaaaggattttgctagcatcgacgttttggtgaataatgcggggaaagcattgggaagagccaatgttggtgaaatttcccaagaggaaatcaatggcatgttccataccaatgttcttgggttgataaacttaactcaggaggtgttacccatcttcaaaaagaaaaatgctggagatattgtgaacattggctcagtggccggtagagaaccttaccctggaggtgcagtatactgtgcttcaaaggcagcagttaactacttttctcattctttgagaaaggaaactatcaattccaaaatcagggtcatggaggtggatcctggggcagtagagacagagttctcgttggttcgttttggcggtgatgccgaggctgcgaaaaaggtgtatgagggaaccgagcctttgggcccagaagatattgcggaaatcattgtgtttgctgtgtcgagaaaagccaaaactgtcattgcggaaactttggtgtttcctacccatcaggctggagcagttcatgttcatagagggccgcttgagtga

SEQ ID NO: 217 - protein, 296 aa, Meyerozyma guilliermondii
MCLLPAGSTVLCHHPVVSVEIKSSIFMSFGAKAAERLANKIILITGASSGIGEATAREFAAAANGKILLILTARREDKLKSLSQQLSLIYPQIKIHSARLDVSEFSSLKPFITGLPKDFASIDVLVNNAGKALGRANVGEISQEEINGMFHTNVLGLINLTQEVLPIFKKKNAGDIVNIGSVAGREPYPGGAVYCASKAAVNYFSHSLRKETINSKIRVMEVDPGAVETEFSLVRFGGDAEAAKKVYEGTEPLGPEDIAEIIVFAVSRKAKTVIAETLVFPTHQAGAVHVHRGPLE

SEQ ID NO: 218 - DNA, 804 bp, Vanderwaltozyma polyspora
atgtcacagggtagaaaggcttcagaaaggttggctggtaaaactgtattaattacaggtgcttcatcagggattgggaaagccactgcattagaatatctagatgcctccaatggtcatatgaagttaattttagttgcaagaagattagaaaaattgcaagagttgaaggaaacaatttgtaaagaatatccagaatctaaggttcatgttgaagaattagatatttctgatattaatagaatcccagaatttattgcaaaattacctgaagaattcaaagatattgatatattgattaacaatgcaggtaaagcattaggaagtgatactattggtaatatcgagaatgaggatattaaaggtatgtttgagactaacgtttttggattaatctgtttaacacaagctgtacttccaatattcaaggctaaaaatggtggtgatattgtcaatttagggtcaattgcaggcatagaagcttacccaacaggatctatatattgtgcaactaaatttgcagttaaagcattcactgaaagtttaagaaaggaattgattaatacaaagatcagagttattgaaattgcaccaggtatggttaacactgaattttctgtaattagatataaaggtgaccaagaaaaggcagataaagtttatgaaaacactactcctttatatgcagatgacatcgctgatttgatagtttacaccacttctagaaaatcgaataccgttatcgctgatgttttggtattcccaacatgccaagcttctgcatcccatatctatcgtggataa

SEQ ID NO: 219 - protein, 267 aa, Vanderwaltozyma polyspora
MSQGRKASERLAGKTVLITGASSGIGKATALEYLDASNGHMKLILVARRLEKLQELKETICKEYPESKVHVEELDISDINRIPEFIAKLPEEFKDIDILINNAGKALGSDTIGNIENEDIKGMFETNVFGLICLTQAVLPIFKAKNGGDIVNLGSIAGIEAYPTGSIYCATKFAVKAFTESLRKELINTKIRVIEIAPGMVNTEFSVIRYKGDQEKADKVYENTTPLYADDIADLIVYTTSRKSNTVIADVLVFPTCQASASHIYRG

SEQ ID NO: 220 - DNA, 807 bp, Candida dubliniensis
atgtcatttggtagaaaagctgctgaaagattagccaatagatccattcttatcactggtgcttcatctgggattggtgaagcatgtgctaaagttttcgctgaagcatctaatggtcaagttaaattagttttaggagcaagaagaaaagaacgattagttaaattatctgatactttaattaaacaatatcctaatattaaaattcatcatgattttttggatgttactattaaagattcaatttcaaaattcattgctggaattcctcatgaatttgaacctgatgtattaattaataatagtggtaaagccttggggaaagaagaagttggagaattgaaagatgaagatattacggaaatgtttgatactaatgtcattggagtcattcgtatgactcaagcagttttacctttacttaaaaaaaaaccttatgctgatgtggttttcattggaagtattgctggacgtgttccttataaaaatggaggtggttattgtgcatctaaagctgctgttcgtagtttcaccgatacatttagaaaagaaactattaatactggtattagagtcattgaagttgatccaggtgcagtacttactgaatttagtgttgttcgttataaaggtgacactgatgctgccgatgctgtttatactggtactgaaccattaacaccagaagatgttgctgaagtggttgtttttgcatcttcaagaaaacaaaataccgttattgctgatactttgattttcccaaatcatcaagcttctccagatcatgtttatagaaaacctaattaa

SEQ ID NO: 221 - protein, 268 aa, Candida dubliniensis
MSFGRKAAERLANRSILITGASSGIGEACAKVFAEASNGQVKLVLGARRKERLVKLSDTLIKQYPNIKIHHDFLDVTIKDSISKFIAGIPHEFEPDVLINNSGKALGKEEVGELKDEDITEMFDTNVIGVIRMTQAVLPLLKKKPYADVVFIGSIAGRVPYKNGGGYCASKAAVRSFTDTFRKETINTGIRVIEVDPGAVLTEFSVVRYKGDTDAADAVYTGTEPLTPEDVAEVVVFASSRKQNTVIADTLIFPNHQASPDHVYRKPN

SEQ ID NO: 222 - DNA, 822 bp, Zygosaccharomyces rouxii
atgtcacaaggtgtcaaagctgctgaaagactagctggtaagactgtattcattacaggtgcttctgcaggtatcggtcaagcaactgcaaaggaatatttggatgcatccaatggtcaaattaaattgatcttggctgcaagaagattagagaaattacacgagtttaaagaacaaactacaaagagttacccaagcgctcaagtccacattggtaaattggacgtcactgcaattgacaccataaaaccatttttggataaattaccaaaggaatttcaagatatcgatattttgatcaacaatgccggtaaggcattaggtactgataaagttggtgatattgcagatgaagacgtggaaggtatgttcgacaccaatgtcttggggttaatcaaagttactcaagctgttttacctatcttcaaaagaaaaaattctggtgatgtcgttaacattagttcggttgctggtagagaggcatacccaggtggttccatttactgtgctactaaacacgctgttaaggcattcactgaaagtttgcgtaaggaattagtcgatacaaaaatcagagtcatgagtattgatcctggtaatgtagagaccgaattttctatggttagattccgtggtgatacagaaaaggcaaagaaggtttaccaagacactgtcccattatatgcagatgacattgcagatttaatcgtctatgcaacctctagaaagcaaaacactgtcattgctgacactttgatcttctcttctaaccaggcatcaccataccacctctacagaggctctcaagacaaaaccaattga

SEQ ID NO: 223 - protein, 273 aa, Zygosaccharomyces rouxii
MSQGVKAAERLAGKTVFITGASAGIGQATAKEYLDASNGQIKLILAARRLEKLHEFKEQTTKSYPSAQVHIGKLDVTAIDTIKPFLDKLPKEFQDIDILINNAGKALGTDKVGDIADEDVEGMFDTNVLGLIKVTQAVLPIFKRKNSGDVVNISSVAGREAYPGGSIYCATKHAVKAFTESLRKELVDTKIRVMSIDPGNVETEFSMVRFRGDTEKAKKVYQDTVPLYADDIADLIVYATSRKQNTVIADTLIFSSNQASPYHLYRGSQDKTN

SEQ ID NO: 224 - DNA, 804 bp, Lachancea thermotolerans
atgtcacagggaagaagagcagctgaaagactggcaggaaagactgtcttcatcacaggcgcatcagccggtatcggtcaggccactgcgcaagaatacctggaagcatccgaaggcaaaatcaagttgatccttgcagcaagaagactcgacaagctggaggaaatcaaagccaaggtttctaaagacttccctgaagcacaggtgcatatcggccagctagatgtgactcagacggacaaaatccagccttttgtcgacaatttgcccgaagagttcaaagacatcgacatcctgatcaacaacgcgggcaaggcgctcggatccgaccccgtgggcacaatcgaccccaatgatattcaaggcatgatccagactaacgttatcgggcttataaatgttacccaagccgttctgcccatcttcaaggccaaaaactctggtgatatcgtgaacctgggttctgtcgctggcagagaagcttaccctacaggatctatttactgcgctacgaagcacgcggtgcgtgctttcacccagagcctgcgcaaggaactgatcaacacaaacatcagggttattgaggtcgctccaggtaacgtggagaccgagttttctctggttagatacaagggcgactctgagaaagccaagaaggtttacgaaggcacacaacccctttacgctgacgatatcgcagacctaatcgtttacgcaacctcgagaaaaccaaacaccgtcatcgcggacgttttggttttcgcttcgaaccaggcttcgccttaccacatttaccgtggttag

SEQ ID NO: 225 - protein, 267 aa, Lachancea thermotolerans
MSQGRRAAERLAGKTVFITGASAGIGQATAQEYLEASEGKIKLILAARRLDKLEEIKAKVSKDFPEAQVHIGQLDVTQTDKIQPFVDNLPEEFKDIDILINNAGKALGSDPVGTIDPNDIQGMIQTNVIGLINVTQAVLPIFKAKNSGDIVNLGSVAGREAYPTGSIYCATKHAVRAFTQSLRKELINTNIRVIEVAPGNVETEFSLVRYKGDSEKAKKVYEGTQPLYADDIADLIVYATSRKPNTVIADVLVFASNQASPYHIYRG

SEQ ID NO: 226 - DNA, 807 bp, Kluyveromyces lactis
atgtctcaaggtagaaaggctgctgaaagattgcaaaacaagacaattttcattaccggtgcttctgcaggtattggtcaagccacagcattggaatatctagatgctgctaacggtaatgtcaaattgatcttagcagcaagaaggttggctaagttggaagaattgaaggaaaaaatcaatgctgaatacccacaagctaaagtatatatcggtcaattggacgtcactgaaactgagaagattcaacctttcattgataacttgccggaagaattcaaggatatcgatattttgattaacaatgccggtaaagctttgggatctgatgttgtcggtaccatcagtagcgaggacatcaaaggtatgatagatactaacgttgttgcccttatcaacgttacccaagctgttttgcctattttcaaagcaaagaattccggtgacatcgttaacttaggttctgttgccggtagagatgcatatccaactggttctatctattgtgcttcgaagcatgctgtcagagcgttcactcagtctttgagaaaagaattaatcaatactggtattagggtcattgagattgctccaggtaatgtcgaaactgagttctctctagttagatacaagggtgatgccgatcgtgctaaacaggtttacaaaggtactactcctctatatgcagatgacattgctgacttgatcgtttatgccacttcaagaaaacctaatactgtcatcgctgatgttttggtatttgcttccaaccaagcatctccttaccacatttaccgtggcgaatag

SEQ ID NO: 227 - protein, 268 aa, Kluyveromyces lactis
MSQGRKAAERLQNKTIFITGASAGIGQATALEYLDAANGNVKLILAARRLAKLEELKEKINAEYPQAKVYIGQLDVTETEKIQPFIDNLPEEFKDIDILINNAGKALGSDVVGTISSEDIKGMIDTNVVALINVTQAVLPIFKAKNSGDIVNLGSVAGRDAYPTGSIYCASKHAVRAFTQSLRKELINTGIRVIEIAPGNVETEFSLVRYKGDADRAKQVYKGTTPLYADDIADLIVYATSRKPNTVIADVLVFASNQASPYHIYRGE

SEQ ID NO: 228 - DNA, 807 bp, Saccharomyces kluyveri
atgtctcaaggtagaagggctgcagaaagactagcaaacaagaccgtttttataactggcgcctctgccggcattggccaagctactgctttggaatactgtgatgcttctaacggtaaaataaacttggtgttaagtgccagaaggctggaaaaattgcaagagttaaaggacaaaatcaccaaggagtatcctgaagccaaggtttatattggtgtgcttgatgtgaccgaaacggaaaaaatcaaaccattcttggatggtttaccagaagaatttaaagatattgacatcttgatcaataatgcaggcaaagcgttaggctctgatcctgttggtaccatcaaaactgaagatattgaaggaatgatcaacaccaatgtcttagctcttatcaatattactcaagctgtcttgccaatcttcaaagccaagaatttcggtgatatcgtaaacttggggtctgtcgctggtagagatgcttatccaaccggtgcaatctactgtgctagcaaacatgcagtcagagccttcactcaaagtttgaggaaggaattggtgaacaccaatatcagagtgattgaaattgctccgggtaatgttgaaaccgagttttccttagttagatataaaggtgatacggaccgtgctaaaaaggtttatgaaggtactaacccattatatgcagatgacattgcagaccttattgtgtatgctacttctagaaagcctaatactgtcattgcggatgttttggtttttgcttcaaaccaagcatccccttaccatatctatcgcggtgactaa

SEQ ID NO: 229 - protein, 268 aa, Saccharomyces kluyveri
MSQGRRAAERLANKTVFITGASAGIGQATALEYCDASNGKINLVLSARRLEKLQELKDKITKEYPEAKVYIGVLDVTETEKIKPFLDGLPEEFKDIDILINNAGKALGSDPVGTIKTEDIEGMINTNVLALINITQAVLPIFKAKNFGDIVNLGSVAGRDAYPTGAIYCASKHAVRAFTQSLRKELVNTNIRVIEIAPGNVETEFSLVRYKGDTDRAKKVYEGTNPLYADDIADLIVYATSRKPNTVIADVLVFASNQASPYHIYRGD

SEQ ID NO: 230 - DNA, 807 bp, Yarrowia lipolytica
atgtctttcggagataaagctgctgctcgacttgcgggcaagaccgtctttgttaccggcgcctcgtccggcattggccaggccactgttctcgctctagccgaagctgccaagggcgacctcaagtttgtgcttgctgcccgacgaaccgaccgtctggacgagctcaagaagaagctggagaccgactacaagggtatccaggtgctgcctttcaagctggacgtgtccaaggtcgaggagaccgagaacattgtgtccaagctgcccaaggagttttccgaggtggacgtgcttatcaacaacgccggcatggtccacggcaccgaaaaggttggctccatcaaccagaacgacattgagatcatgttccacacaaacgtgctcggactcatttctgtcactcagcagtttgtcggcgagatgcgaaagcgaaacaagggcgacattgtcaacattggctccatcgccggacgagagccctacgttggaggaggaatctactgtgccaccaaggccgccgtgcgatctttcactgagactctccgaaaagagaacatcgacactcgaatccgagtcattgaggttgatcctggagccgttgagaccgagttctccgtcgtgcgattccgaggagacaagtccaaggccgacgctgtttacgctggaaccgagcctctggtcgctgacgatattgccgagttcatcacctacactctcactcgacgagagaatgtcgtcattgccgatactctcattttccccaaccaccaggcttctcctactcacgtctaccgaaagaactga

SEQ ID NO: 231 - protein, 268 aa, Yarrowia lipolytica
MSFGDKAAARLAGKTVFVTGASSGIGQATVLALAEAAKGDLKFVLAARRTDRLDELKKKLETDYKGIQVLPFKLDVSKVEETENIVSKLPKEFSEVDVLINNAGMVHGTEKVGSINQNDIEIMFHTNVLGLISVTQQFVGEMRKRNKGDIVNIGSIAGREPYVGGGIYCATKAAVRSFTETLRKENIDTRIRVIEVDPGAVETEFSVVRFRGDKSKADAVYAGTEPLVADDIAEFITYTLTRRENVVIADTLIFPNHQASPTHVYRKN

SEQ ID NO: 232 - DNA, 780 bp, Schizosaccharomyces pombe
atgagccgtttggatggaaaaacgattttaatcactggtgcctcttctggaattggaaaaagcactgcttttgaaattgccaaagttgccaaagtaaaacttattttggctgctcgcagattttctaccgttgaagaaattgcaaaggagttagaatcgaaatatgaagtatcggttcttcctcttaaattggatgtttctgatttgaagtctattcctggggtaattgagtcattgccaaaggaatttgctgatatcgatgtcttgattaataatgctggacttgctctaggtaccgataaagtcattgatcttaatattgatgacgccgttaccatgattactaccaatgttcttggtatgatggctatgactcgtgcggttcttcctatattctacagcaaaaacaagggtgatattttgaacgttggcagtattgccggcagagaatcatacgtaggcggctccgtttactgctctaccaagtctgcccttgctcaattcacttccgctttgcgtaaggagactattgacactcgcattcgtattatggaggttgatcctggcttggtcgaaaccgaattcagcgttgtgagattccacggagacaaacaaaaggctgataatgtttacaaaaatagtgagcctttgacacccgaagacattgctgaggtgattctttttgccctcactcgcagagaaaacgtcgttattgccgatacacttgttttcccatcccatcaaggtggtgccaatcatgtgtacagaaagcaagcgtag

SEQ ID NO: 233 - protein, 259 aa, Schizosaccharomyces pombe
MSRLDGKTILITGASSGIGKSTAFEIAKVAKVKLILAARRFSTVEEIAKELESKYEVSVLPLKLDVSDLKSIPGVIESLPKEFADIDVLINNAGLALGTDKVIDLNIDDAVTMITTNVLGMMAMTRAVLPIFYSKNKGDILNVGSIAGRESYVGGSVYCSTKSALAQFTSALRKETIDTRIRIMEVDPGLVETEFSVVRFHGDKQKADNVYKNSEPLTPEDIAEVILFALTRRENVVIADTLVFPSHQGGANHVYRKQA

SEQ ID NO: 234 - DNA, 1689 bp, Artificial Sequence
  PDC1 pyruvate decarboxylase from Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaa

SEQ ID NO: 235 - protein, 563 aa, Artificial Sequence
  PDC1 pyruvate decarboxylase from Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 236 - DNA, 1689 bp, Artificial Sequence
  PDC5 pyruvate decarboxylase from Saccharomyces cerevisiae
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaa

SEQ ID NO: 237 - protein, 563 aa, Artificial Sequence
  PDC5 pyruvate decarboxylase from Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 238 - DNA, 1599 bp, Artificial Sequence
  PDC6 pyruvate decarboxylase from Saccharomyces cerevisiae
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 239 - protein, 533 aa, Artificial Sequence
  PDC6 pyruvate decarboxylase from Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 240 - DNA, 1692 bp, Artificial Sequence
  pyruvate decarboxylase from Candida glabrata
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaa

SEQ ID NO: 241 - protein, 564 aa, Artificial Sequence
  pyruvate decarboxylase from Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 242 - DNA, 1788 bp, Artificial Sequence
  PDC1 pyruvate decarboxylase from Pichia stipitis
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagct

SEQ ID NO: 243 - protein, 596 aa, Artificial Sequence
  PDC1 pyruvate decarboxylase from Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSSNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 244 - DNA, 1707 bp, Artificial Sequence
  PDC2 pyruvate decarboxylase from Pichia stipitis
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaat

SEQ ID NO: 245 - protein, 569 aa, Artificial Sequence
  PDC2 pyruvate decarboxylase from Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 246 - DNA, 1692 bp, Artificial Sequence
  pyruvate decarboxylase from Kluyveromyces lactis
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtgctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctcacttggttctatcggtcggtgctctattgtccgatttcaacactggttctttctcttactcttacaagaccaagaacattgtcgaattccactctgactacaccaagatcagaaggcctaccttcccaggtgtccaaatgaagttcgctttacaaaaattgttgactaaggttgccgatgctgctaagggttacaagccagttccagttccatctgaaccagaacacaacgaagatgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgcatccaacgctaagaactaa

SEQ ID NO: 247 - protein, 563 aa, Artificial Sequence
  pyruvate decarboxylase from Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 248 - DNA, 1716 bp, Artificial Sequence
  pyruvate decarboxylase from Yarrowia lipolytica
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 249 - protein, 571 aa, Artificial Sequence
  pyruvate decarboxylase from Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 250 - DNA, 1716 bp, Artificial Sequence
  pyruvate decarboxylase from Schizosaccharomyces pombe
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 251 - protein, 571 aa, Artificial Sequence
  pyruvate decarboxylase from Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 252 - DNA, 1689 bp, Artificial Sequence
  pyruvate decarboxylase from Zygosaccharomyces rouxii
atgtctgaaattactctaggtcgttacttgttcgaaagattaaagcaagttgacactaacaccatcttcggtgttccaggtgacttcaacttgtccttgttggacaaggtctacgaagtgcaaggtctaagatgggctggtaacgctaacgaattgaacgctgcctacgctgctgacggttacgccagagttaagggtttggctgctttgatcaccaccttcggtgtcggtgaattgtctgctttgaacggtattgcaggttcttacgctgaacacgttggtgttttgcacattgttggtgttccatctgtctcttctcaagctaagcaattgttgttgcaccacaccttgggtaacggtgacttcactgttttccacagaatgtccgccaacatctctgaaaccaccgctatgttgaccgacatcactgctgctccagctgaaattgaccgttgcatcagagttgcttacgtcaaccaaagaccagtctacttgggtctaccagctaacttggttgaccaaaaggtcccagcttctttgttgaacactccaattgatctatctctaaaggagaacgacccagaagctgaaaccgaagttgttgacaccgttttggaattgatcaaggaagctaagaacccagttatcttggctgatgcttgctgctccagacacgacgtcaaggctgaaaccaagaagttgatcgacttgactcaattcccatctttcgttactcctatgggtaagggttccatcgacgaacaaaacccaagattcggtggtgtctacgtcggtactctatccagcccagaagttaaggaagctgttgaatctgctgacttggttctatctgtcggtgctctattgtccgatttcaacactggttctttctcttactcttacaagaccaagaacgttgttgaattccactctgaccacatcaagatcagaaacgctaccttcccaggtgttcaaatgaaattcgttttgaagaaactattgcaagctgtcccagaagctgtcaagaactacaagccaggtccagtcccagctccgccatctccaaacgctgaagttgctgactctaccaccttgaagcaagaatggttatggagacaagtcggtagcttcttgagagaaggtgatgttgttattaccgaaactggtacctctgctttcggtatcaaccaaactcacttccctaaccaaacttacggtatctctcaagtcttgtggggttctattggttacaccactggttccactttgggtgctgccttcgctgctgaagaaattgaccctaagaagagagttatcttgttcattggtgacggttctctacaattgaccgttcaagaaatctccaccatgatcagatggggtctaaagccatacttgttcgttttgaacaacgatggttacaccattgaaagattgattcacggtgaaaccgctgaatacaactgtatccaaccatggaagcacttggaattgttgaacaccttcggtgccaaggactacgaaaaccacagagtctccactgtcggtgaatggaacaagttgactcaagatccaaaattcaacgaaaactctagaattagaatgatcgaagttatgcttgaagtcatggacgctccatcttctttggtcgctcaagctcaattgaccgctgctactaacgctaagcaa

SEQ ID NO: 253 - protein, 563 aa, Artificial Sequence
  pyruvate decarboxylase from Zygosaccharomyces rouxii
MSEITLGRYLFERLKQVDTNTIFGVPGDFNLSLLDKVYEVQGLRWAGNANELNAAYAADGYARVKGLAALITTFGVGELSALNGIAGSYAEHVGVLHIVGVPSVSSQAKQLLLHHTLGNGDFTVFHRMSANISETTAMLTDITAAPAEIDRCIRVAYVNQRPVYLGLPANLVDQKVPASLLNTPIDLSLKENDPEAETEVVDTVLELIKEAKNPVILADACCSRHDVKAETKKLIDLTQFPSFVTPMGKGSIDEQNPRFGGVYVGTLSSPEVKEAVESADLVLSVGALLSDFNTGSFSYSYKTKNVVEFHSDHIKIRNATFPGVQMKFVLKKLLQAVPEAVKNYKPGPVPAPPSPNAEVADSTTLKQEWLWRQVGSFLREGDVVITETGTSAFGINQTHFPNQTYGISQVLWGSIGYTTGSTLGAAFAAEEIDPKKRVILFIGDGSLQLTVQEISTMIRWGLKPYLFVLNNDGYTIERLIHGETAEYNCIQPWKHLELLNTFGAKDYENHRVSTVGEWNKLTQDPKFNENSRIRMIEVMLEVMDAPSSLVAQAQLTAATNAKQ

SEQ ID NO: 254 - DNA, 1461 bp, Artificial Sequence
  HXK2 from S. cerevisiae
atggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaa

SEQ ID NO: 255 - protein, 486 aa, Artificial Sequence
  HXK2 from S. cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 256 - DNA, 1458 bp, Artificial Sequence
  RAG5 from K. lactis
atggttcgtttaggtccaaagaagcctccagccagaaaggggtccatggcagatgtgccagctaatttgatggaacaaatccacggtttggaaactttgttcaccgtctcttcagaaaaaatgagaagcattgtcaagcatttcatcagtgaattggacaaaggtttgtccaaaaagggtggtaacattcctatgattccaggttgggttgttgagtatccaactggtaaggaaactggtgatttcttagctcttgatttgggtggtaccaacttgagagttgtgttggttaaattgggtggtaatcatgatttcgacaccactcaaaacaagtacagattaccagaccatttgagaactggtacttctgaacaattgtggtcatttattgcaaagtgtttgaaggaattcgtcgatgaatggtacccagatggtgtttctgaaccattgccattgggtttcactttctcataccctgcatctcaaaagaagatcaattccggtgtgttgcaacgttggaccaagggtttcgatattgaaggtgttgaaggtcacgatgttgttccaatgctacaagaacagattgaaaagctgaatatcccaatcaatgtcgttcgattgatcaacgataccactggtaccttggttgcctctttgtacactgatcctcaaactaagatgggtatcattatcggtactggtgtcaacggtgcttactacgatgttgtttctggtattgagaaattggaaggtttgttgccagaagatatcggtccagattctccaatggcaatcaactgtgaatatggttccttcgataacgaacatttggtgttgccaagaaccaaatacgatgttataatcgatgaagaatctccaagaccaggtcaacaagctttcgaaaagatgacttctggttactatctaggtgaaatcatgcgtctagtactattggacttgtacgacagtggtttcatctttaaggaccaagatatctccaagttgaaagaggcttacgtcatggacaccagttatccatctaagatcgaagatgatccattcgaaaacttggaagacactgacgatctgttcaagactaacttgaacatcgaaactaccgttgttgagagaaagttgattagaaaattagccgaattggtcggaacaagagctgcaagattgactgtttgtggtgtttctgctatctgtgacaagagaggctacaagactgctcacattgcagctgatggttctgtcttcaacagatacccaggttacaaggaaaaggccgctcaagccttgaaggatatctacaactgggatgtcgaaaagatggaagaccacccaatccaattggtggctgctgaagatggttccggtgttggtgctgctatcattgcttgtttgactcaaaagagattggctgccggtaagtctgttggtattaaaggcgaatag

SEQ ID NO: 257 - protein, 485 aa, Artificial Sequence
  RAG5 from K. lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVRLINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 258 - DNA, 1416 bp, Artificial Sequence
  HPGLK1 from H. polymorpha
atgagtttggatactgaagtcgataagattgtgtcggagtttgccgtcacccaggagacactccaaaagggtgtggagcgtttcattgagcttgcaactgccggactgaatagtgatgaggacaagtatggtctgccaatgatcccaacttttgttacctccatcccaaccggtaaagagaagggcattctttttgccgcagacttgggaggaaccaatttcagagtttgctctgttgccttgaacggagatcacactttcaaactgatccagcagaagtcacatattcctgccgaactgatgacctccacctcggacgaattgttttcgtatcttgcaagcaaggtcaagaatttcttagagactcatcatgaaggggctgttacttctacaggaagccagaaattcaagatgggtttcactttcagtttccctgtctcgcagaccgccttaaacgccggtactttgctaagatggaccaagggattcaatattccggatactgttggtcaagaggttgtttctctattccaaatgcatttagacgcccaggaaattcctgttactgtgtctgccctgtccaacgatactgtgggaacccttcttgcaagatcctacacgggttccaataaggagggcactactgttctaggatgcatcttcggaacgggaacaaacggtgcttacaacgagaagctcgagaatatcaagaagcttccggccgaggtgagagagaagctgaaggctcaaggtgtcacccacatggtcattaatactgaatggggttccttcgataaccagctcaaggttttgccaaatacgaagtatgacgctcaagttgacgaacttaccggcaataagggcttccacatgtttgaaaagcgtgtttccggaatgttcttgggtgagattctgagacatattttggtcgaccttcactctaagggagtgctatttactcagtacgccagctacgaatccctgccccacagattgaggacgccgtgggatctggactctgaggttctctcactgattgagatcgacgaatccaccaatttgcaggccactgagctgtctttgaaacaggcattgagactgccaactactactgaggagagacttgctattcaaaaacttactcgtgctgtggccaagagatctgcctatcttgctgctattcctattgctgctattctacacatgaccgagtcttttaagggccacaacgttgaggtggacgttggagcagacgggtctgtggttgagttctaccctggattcagaactatgatgagagacgccattgcgcagacgcagataggtgccaaaggagagagaagactgcacattaacattgccaaagacggctcatctgtgggcgctgcattgtgcgcattaagcgagaaagactaa

SEQ ID NO: 259 - protein, 471 aa, Artificial Sequence
  HPGLK1 from H. polymorpha
MSLDTEVDKIVSEFAVTQETLQKGVERFIELATAGLNSDEDKYGLPMIPTFVTSIPTGKEKGILFAADLGGTNFRVCSVALNGDHTFKLIQQKSHIPAELMTSTSDELFSYLASKVKNFLETHHEGAVTSTGSQKFKMGFTFSFPVSQTALNAGTLLRWTKGFNIPDTVGQEVVSLFQMHLDAQEIPVTVSALSNDTVGTLLARSYTGSNKEGTTVLGCIFGTGTNGAYNEKLENIKKLPAEVREKLKAQGVTHMVINTEWGSFDNQLKVLPNTKYDAQVDELTGNKGFHMFEKRVSGMFLGEILRHILVDLHSKGVLFTQYASYESLPHRLRTPWDLDSEVLSLIEIDESTNLQATELSLKQALRLPTTTEERLAIQKLTRAVAKRSAYLAAIPIAAILHMTESFKGHNVEVDVGADGSVVEFYPGFRTMMRDAIAQTQIGAKGERRLHINIAKDGSSVGAALCALSEKD

SEQ ID NO: 260 - DNA, 1634 bp, Artificial Sequence
  HXK2 from S. pombe
aacacttttcgcctcacttgcgaatctacgaaaggaatatataggtggttcaccccttttcttttcatttcgtgtttttaatagttatttacatcaacagagataactatttctgttaacgattttttttcccacttgttttcttccttttttggtgaattttaattaatttataataagcaatggaggctaattttcaacaagctgttaaaaagttagtcaatgactttgaataccctaccgagtccttgagagaggccgttaaggagtttgacgaattacgtcaaaagggtttacaaaagaatggtgaggtgcttgctatggctcctgcctttatctctacccttcccaccggcgctgaaactggtgacttcttggcccttgactttggtggtaccaacttgcgtgtttgttggatccaacttctcggtgacggcaagtatgagatgaagcacagcaagtccgtcttgccccgtgaatgcgttcgtaacgagtctgttaagcccatcattgactttatgagtgaccatgttgagcttttcatcaaggagcacttcccttccaagtttggctgccctgaggaggaataccttcctatgggtttcaccttttcttatcccgccaaccaagtttccatcaccgagagctacttgcttcgttggaccaagggtcttaacattcctgaggccatcaacaaggactttgcccaatttttgactgaaggtttcaaggctcgtaaccttcctattagaatcgaggctgtcatcaacgataccgtcggtactctcgttacccgtgcttatacttcaaaggagagcgacacctttatgggtatcattttcggaaccggtaccaacggtgcttacgtcgagcaaatgaaccaaattcccaagcttgctggcaagtgtactggtgatcatatgcttatcaacatggaatggggagcaactgatttctcttgccttcactccactcgttatgatttacttcttgatcatgatactcccaatgctggtcgtcaaatctttgagaagcgcgttggtggtatgtatctcggtgagcttttccgccgtgccttattccacttgatcaaggtttacaacttcaacgaaggtattttccctccttccattactgatgcttggtctttggaaacttctgttctttccagaatgatggttgaacgttctgctgagaatgttcgtaacgttcttagtacattcaagttccgtttccgcagcgacgaagaggctttgtacctttgggatgctgctcatgcaattggccgtcgtgctgctcgtatgtctgccgttcccattgcttctttgtatctttctaccggccgcgctggtaagaagagtgatgttggtgttgatggttctttagtcgaacactatcctcactttgttgacatgctccgtgaagccttgcgtgagcttatcggtgataacgaaaaattgatttccattggtattgccaaggatggcagtggtattggtgccgctctttgcgccctccaagctgttaaggaaaagaaaggcttggcctaaatcatgttagatgtctgttagctttttttgaattgtacgtagaaatgagcatgtaaatatgaaattgctttttaacagctttta

SEQ ID NO: 261 - protein, 455 aa, Artificial Sequence
  HXK2 from S. pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 262 - DNA, 978 bp, Lactobacillus plantarum
atggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaa

SEQ ID NO: 263 - DNA, 2367 bp, Lactobacillus plantarum
atgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataa

SEQ ID NO: 264 - DNA, 719 bp, Artificial sequence
  Promoter UAS(PGK1)-PFBA1
aattaccgtcgctcgtgatttgtttgcaaaaagaacaaaactgaaaaaacccagacacgctcgacttcctgtcttcctattgattgcagcttccaatttcgtcacacaacaaggtcctgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 265 - DNA, 636 bp, Artificial sequence
  Promoter UAS(PGK1)-ENO2p
aattaccgtcgctcgtgatttgtttgcaaaaagaacaaaactgaaaaaacccagacacgctcgacttcctgtcttcctattgattgcagcttccaatttcgtcacacaacaaggtcctgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 266 - DNA, 979 bp, Artificial sequence
  UAS(FBA1)-PDC1p
tgacagcaggattatcgtaatacgtaatagttgaaaatctcaaaaatgtgtgggtcattacgtaaataatgataggaatgggattcttctatttttcctttttccattctcgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 267 - DNA, 994 bp, Artificial sequence
  Promoter UAS(PGK1)-PDC1p
aattaccgtcgctcgtgatttgtttgcaaaaagaacaaaactgaaaaaacccagacacgctcgacttcctgtcttcctattgattgcagcttccaatttcgtcacacaacaaggtcctgtcgacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 268 - DNA, 731 bp, Artificial sequence
  Promoter UAS(PGK)-OLE1p
aattaccgtcgctcgtgatttgtttgcaaaaagaacaaaactgaaaaaacccagacacgctcgacttcctgtcttcctattgattgcagcttccaatttcgtcacacaacaaggtcctgtcgaccggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaa

SEQ ID NO: 269 - DNA, 32 bp, Artificial sequence
  Primer oBP622
aattggtaccccaaaaggaatattgggtcaga

SEQ ID NO: 270 - DNA, 49 bp, Artificial sequence
  Primer oBP623
ccattgtttaaacggcgcgccggatcctttgcgaaaccctatgctctgt

SEQ ID NO: 271 - DNA, 49 bp, Artificial sequence
  Primer oBP624
gcaaaggatccggcgcgccgtttaaacaatggaaggtcgggatgagcat

SEQ ID NO: 272 - DNA, 34 bp, Artificial sequence
  Primer oBP625
aattggccggcctacgtaacattctgtcaaccaa

SEQ ID NO: 273 - DNA, 34 bp, Artificial sequence
  Primer oBP626
aattgcggccgcttcatatatgacgtaataaaat

SEQ ID NO: 274 - DNA, 34 bp, Artificial sequence
  Primer oBP627
aattttaattaattttttttcttggaatcagtac

SEQ ID NO: 275 - DNA, 40 bp, Artificial sequence
  Primer HY21
ttaaggcgcgcctatttgtaatacgtatacgaattccttc

SEQ ID NO: 276 - DNA, 56 bp, Artificial sequence
  Primer HY24
acttaataactttaccggctgttgacattttgttcttcttgttattgtattgtgtt

SEQ ID NO: 277 - DNA, 56 bp, Artificial sequence
  Primer HY25
aacacaatacaataacaagaagaacaaaatgtcaacagccggtaaagttattaagt

SEQ ID NO: 278 - DNA, 40 bp, Artificial sequence
  Primer HY4
ggaagtttaaacaccacaggtgttgtcctctgaggacata

SEQ ID NO: 279 - DNA, 12896 bp, artificial sequence; identical to SEQ ID NO: 163
  pBP915 plasmid

SEQ ID NO: 280 - DNA, 30 bp, Artificial sequence
  Primer URA3-end F
gcatatttgagaagatgcggccagcaaaac

SEQ ID NO: 281 - DNA, 22 bp, Artificial sequence
  Primer oBP636
catttttttccctctaagaagc

SEQ ID NO: 282 - DNA, 22 bp, Artificial sequence
  Primer oBP637
tttttgcacagttaaactaccc

SEQ ID NO: 283 - DNA, 40 bp, Artificial sequence
  Primer oBP691
aattggatccgcgatcgcgacgttctctccgttgttcaaa

SEQ ID NO: 284 - DNA, 41 bp, Artificial sequence
  Primer oBP692
aattggcgcgccatttaaatatatatgtatatatataacac

SEQ ID NO: 285 - DNA, 34 bp, Artificial sequence
  Primer oBP693
aattgtttaaacaaaggatgatattgttctatta

SEQ ID NO: 286 - DNA, 33 bp, Artificial sequence
  Primer oBP694
aattggccggccgcaacgacgacaatgccaaac

SEQ ID NO: 287 - DNA, 34 bp, Artificial sequence
  Primer oBP695
aattgcggccgcatgacaggtgaaagaattgaaa

SEQ ID NO: 288 - DNA, 34 bp, Artificial sequence
  Primer oBP696
aattttaattaaacgggcatcttatagtgtcgtt

SEQ ID NO: 289 - DNA, 40 bp, Artificial sequence
  Primer HY16
ttaaggcgcgccccgcacgccgaaatgcatgcaagtaacc

SEQ ID NO: 290 - DNA, 56 bp, Artificial sequence
  Primer HY19
acttaataactttaccggctgttgacattttgattgatttgactgtgttattttgc

SEQ ID NO: 291 - DNA, 56 bp, Artificial sequence
  Primer HY20
gcaaaataacacagtcaaatcaatcaaaatgtcaacagccggtaaagttattaagt

SEQ ID NO: 292 - DNA, 22 bp, Artificial sequence
  Primer oBP730
ttgctccaaagagatgtcttta

SEQ ID NO: 293 - DNA, 22 bp, Artificial sequence
  Primer oBP731
tgttcccacaatctattaccta

SEQ ID NO: 294 - DNA, 34 bp, Artificial sequence
  Primer HY31
gccgactttatggcgaagaagtttgctcttgatc

SEQ ID NO: 295 - DNA, 23 bp, Artificial sequence
  Primer N1251
ccaatgtggctgtggtttcaggg

SEQ ID NO: 296 - DNA, 26 bp, Artificial sequence
  Primer N1252
gcaaggccatgaagctttttctttcc

SEQ ID NO: 297 - DNA, 62 bp, Artificial sequence
  Primer N1253
ggaaagaaaaagcttcatggccttgcgctcatcaacactaaaattagagtcattctaattgc

SEQ ID NO: 298 - DNA, 29 bp, Artificial sequence
  Primer N1254
ttatccacggaagatatgatgaggtgacg

SEQ ID NO: 299 - DNA, 64 bp, Artificial sequence
  Primer N1255
ggaccctgaaaccacagccacattggtaccttccttgccaaagggattaaacctgacaattacc

SEQ ID NO: 300 - DNA, 29 bp, Artificial sequence
  Primer N1256
acctagctaaactaagtaaatctgtatac

SEQ ID NO: 301 - DNA, 29 bp, Artificial sequence
  Primer N1257
gatgatgctatttggtgcagagggtgatg

SEQ ID NO: 302 - DNA, 60 bp, Artificial sequence
  Primer N1258
cagatttacttagtttagctaggtgtatcaaaatacgttctcaatgttctatttcccgcc

SEQ ID NO: 303 - DNA, 4236 bp, artificial sequence
  pUC19::loxP::URA3::loxP
gatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 304 - DNA, 38 bp, Artificial sequence
  N1179 primer
gcgaattctgatctgatgcgctttgcatatctcatatt

SEQ ID NO: 305 - DNA, 38 bp, Artificial sequence
  N1180 primer
gcggtaccgccgtttcggcttggatacgccatatgcaa

SEQ ID NO: 306 - DNA, 38 bp, Artificial sequence
  N1181 primer
gccgatcgtgtaccaacctgcatttctttccgtcatat

SEQ ID NO: 307 - DNA, 38 bp, Artificial sequence
  N1182 primer
gcgcatgcgtgtaccttttgattggaattggttcgcag

SEQ ID NO: 308 - DNA, 30 bp, Artificial sequence
  N1212 primer
ttctatgttaaattttaacgatgtagacac

SEQ ID NO: 309 - DNA, 30 bp, Artificial sequence
  N1213 primer
atggcgaaatggcagtactcgggggaatgc

SEQ ID NO: 310 - DNA, 25 bp, Artificial sequence
  Primer N1239
gacgaggataatgtgcatgaacggg

SEQ ID NO: 311 - DNA, 24 bp, Artificial sequence
  Primer N1242
gtttcgttgcgttggtggaatggc

SEQ ID NO: 312 - DNA, 28 bp, Artificial sequence
  Primer N1249
gctttatggaccctgaaaccacagccac

SEQ ID NO: 313 - DNA, 27 bp, Artificial sequence
  Primer N1250
ggaaagaaaaagcttcatggccttgcg

SEQ ID NO: 314 - DNA, 17 bp, Artificial sequence
  M13 forward primer
gtaaaacgacggccagt

SEQ ID NO: 315 - DNA, 22 bp, Artificial sequence
  M13 reverse primer
cacacaggaaacagctatgacc

SEQ ID NO: 316 - DNA, 24 bp, Artificial sequence
  Primer N1262
cacgtaagggcatgatagaattgg

SEQ ID NO: 317 - DNA, 26 bp, Artificial sequence
  Primer N1263
ggatatagcagttgttgtacactagc

SEQ ID NO: 318 - DNA, 24 bp, Artificial sequence
  primer N1223
caaggaattaccatcaccgtcacc

SEQ ID NO: 319 - DNA, 27 bp, Artificial sequence
  primer N1225
cttgtgtataatgataaattggttggg

SEQ ID NO: 320 - DNA, 27 bp, Artificial sequence
  Primer N1228
caacggttcatcatctcatggatctgc

SEQ ID NO: 321 - DNA, 26 bp, Artificial sequence
  Primer N1229
gttacttggttctggcgaggtattgg

SEQ ID NO: 322 - DNA, 25 bp, Artificial sequence
  Primer N1230
gtaagaaggttggtattccagctgg

SEQ ID NO: 323 - DNA, 26 bp, Artificial sequence
  Primer N1231
ctgtttcgataccagaacctagaccg

SEQ ID NO: 324 - DNA, 7523 bp, Artificial sequence
  pRS423::GAL1p-Cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 325 - DNA, 34 bp, artificial sequence
  primer oBP562
aattgtttaaacatgtatacagtaggtgactatc

SEQ ID NO: 326 - DNA, 49 bp, artificial sequence
  primer oBP563
aatcataaatcataagaaattcgcttatcagctcttgttttgttctgca

SEQ ID NO: 327 - DNA, 49 bp, artificial sequence
  primer oBP564
ttatttgcagaacaaaacaagagctgataagcgaatttcttatgattta

SEQ ID NO: 328 - DNA, 34 bp, artificial sequence
  primer oBP565
aattggccggccaaaaaaagcatgcacgtataca

SEQ ID NO: 329 - DNA, 32 bp, artificial sequence
  primer oBP505
aattgagctcactgtagccctagacttgatag

SEQ ID NO: 330 - DNA, 35 bp, artificial sequence
  primer oBP506
aattggcgcgcctgtatatgagatagttgattgta

SEQ ID NO: 331 - DNA, 35 bp, artificial sequence
  primer oBP507
aattttaattaagtctaggttctttggctgttcaa

SEQ ID NO: 332 - DNA, 33 bp, artificial sequence
  primer oBP508
aattgtcgactttagaagtgtcaacaacgtatc

SEQ ID NO: 333 - DNA, 34 bp, artificial sequence
  primer oBP674
aattggcgcgccaattaccgtcgctcgtgatttg

SEQ ID NO: 334 - DNA, 34 bp, artificial sequence
  primer oBP675
aattgtttaaacttgaatatgtattacttggtta

SEQ ID NO: 335 - DNA, 15539 bp, Artificial sequence
  Plasmid pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 336 - DNA, 36 bp, Artificial sequence
  Primer oBP821
aattgtttaaactaagcgaatttcttatgatttatg

SEQ ID NO: 337 - DNA, 34 bp, Artificial sequence; identical to SEQ ID NO: 328
  Primer oBP484

SEQ ID NO: 338 - DNA, 37 bp, Artificial sequence
  Primer oBP822
aattgcggccgcgtgcctcatctatatttctgaaatc

SEQ ID NO: 339 - DNA, 37 bp, Artificial sequence
  Primer oBP823
aattttaattaatcagctcttgttttgttctgcaaat

SEQ ID NO: 340 - DNA, 1647 bp, Artificial sequence
  Listeria grayi ketoisovalerate decarboxylase coding sequence--codon optimized for expression in Saccharomyces cerevisiae
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 341 - DNA, 36 bp, Artificial sequence
  Primer oBP828
aattgtttaaacatgtataccgtaggacagtacttg

SEQ ID NO: 342 - DNA, 35 bp, Artificial sequence
  oBP829
aattgtttaaacttaagagttttgcttagataagg

SEQ ID NO: 343 - DNA, 29 bp, Artificial sequence
  Primer FBAp-F
ctacaatcaacagatcgcttcaattacgc

SEQ ID NO: 344 - DNA, 29 bp, Artificial sequence
  Primer HY-50
gagagttcactgtttaacaatagcaatgg

SEQ ID NO: 345 - DNA, 26 bp, Artificial sequence
  Primer oBP834
tgctgatactgctgctaaacaagctg

SEQ ID NO: 346 - protein, 338 aa, Artificial sequence
  KARI variant R8-SOG1_y2
MKVFYDKDCDLSIIQGKKVAIIGFGSQGHAQALNLKDSGVDVTVGLPKGFADVAKAEAHGFKVTDVAEAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 347 - DNA, 9585 bp, Artificial sequence
  example resultant KARI variant expression vector
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcgaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgaaagttttctacgataaagactgcgacctgtcgatcatccaaggtaagaaagttgccatcatcggcttcggttcccagggccacgctcaagcactcaacctgaaggattccggcgtagacgtgactgttggcctgcctaaaggctttgctgatgtagccaaggctgaagcccacggctttaaagtgaccgacgttgctgcagccgttgccggtgccgacttggtcatgatcctgattccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggaggtattcctgacctgatcgcggtttaccaggacgtttccggcaacgccaagaacgtcgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaattcgcgaagatgttcatcagcgaaggcgctaccggctacccatcgatgaccgccaagcgtcgtaacaacgctgctcacggtatcgaaatcatcggcgagcaactgcgcgcgatgatgccttggatcggtgccaacaaaatcgtcgacaaacgtaagaactaaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagacaacatcatccacggttctatactgttgacccaatgcatctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 348 - DNA, 12319 bp, Artificial sequence
  pBP2090_mod
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcatctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 349 - DNA, 12305 bp, Artificial sequence
  pBP2090_mod-R9E8
tctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatgaaagttttctacgataaagactgcgacctgtcgatcatccaaggtaagaaagttgccatcatcggcttcggttcccagggccacgctcaagcactcaacctgaaggattccggcgtagacgtgactgttggcctgcctaaaggctttgctgatgtagccaaggctgaagcccacggctttaaagtgaccgacgttgctgcagccgttgcctgggccgacttggtcatgatcctgattccggacgagttccagtcccagctgtacaagaacgaaatcgagccgaacatcaagaagggcgccactctggccttctcccacggcttcgcgatccactacggtcaggttgtgcctcgtgccgacctcgacgtgatcatgatcgcgccgaaggctccaggccacaccgtacgttccgagttcgtcaagggcggaggtattcctgacctgatcgcggtttaccaggacgtttccggcaacgccaagaacgtcgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgcacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaattcgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaacgtaagaactaaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcatctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagagga

SEQ ID NO: 350 - protein, 338 aa, Artificial sequence
  KARI variant 85023
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 351 - protein, 338 aa, Artificial sequence; identical to SEQ ID NO: 138
  KARI variant 85024

SEQ ID NO: 352 - protein, 338 aa, Artificial sequence
  KARI variant 85025
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 353 - protein, 338 aa, Artificial sequence
  KARI variant 85026
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 354 - protein, 338 aa, Artificial sequence
  KARI variant 85027
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 355 - protein, 338 aa, Artificial sequence
  KARI variant 85028
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 356 - protein, 338 aa, Artificial sequence
  KARI variant 85029
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 357 - protein, 338 aa, Artificial sequence
  KARI variant 85030
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 358 - protein, 338 aa, Artificial sequence
  KARI variant 85031
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 359 - protein, 338 aa, Artificial sequence
  KARI variant 85032
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 360 - protein, 338 aa, Artificial sequence
  KARI variant 85033
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 361 - protein, 338 aa, Artificial sequence
  KARI variant 85034
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 362 - protein, 338 aa, Artificial sequence
  KARI variant 85035
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 363 - protein, 338 aa, Artificial sequence
  KARI variant 85036
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 364 - protein, 338 aa, Artificial sequence
  KARI variant 85037
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 365 - protein, 338 aa, Artificial sequence
  KARI variant 85038
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 366 - protein, 338 aa, Artificial sequence
  KARI variant 85039
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 367 - protein, 338 aa, Artificial sequence
  KARI variant 85040
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIHEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 368 - protein, 338 aa, Artificial sequence
  KARI variant 85041
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 369 - protein, 338 aa, Artificial sequence
  KARI variant 85042
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 370 - protein, 338 aa, Artificial sequence
  KARI variant 85043
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLIYEGGIANMNYSISNNAEYGEYVTGPEVINAESRQAMRNALKRIQDGEFAKMFISEGATGYPSMTAKRRNNAAHGIEIIGEQLRAMMPWIGANKIVDKRKN

SEQ ID NO: 371 - protein, 338 aa, Artificial sequence
  KARI variant 85044
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 372 - protein, 338 aa, Artificial sequence
  KARI variant 85045
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 373 - protein, 338 aa, Artificial sequence
  KARI variant 85046
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 374 - protein, 338 aa, Artificial sequence
  KARI variant 85047
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 375 - protein, 338 aa, Artificial sequence
  KARI variant 85048
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 376 - protein, 338 aa, Artificial sequence
  KARI variant 85049
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSITAKRRNNAAHGIEIIGEQLRAMMPWIGANKIVDKRKN

SEQ ID NO: 377 - protein, 338 aa, Artificial sequence
  KARI variant 85050
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 378 - protein, 338 aa, Artificial sequence
  KARI variant 85051
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 379 - protein, 338 aa, Artificial sequence
  KARI variant 85052
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMHEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 380 - protein, 338 aa, Artificial sequence
  KARI variant 85053
MKVFYDKDCDLSIIQGKKVAIIGFGSQGHAQALNLKDSGVDVTVGLPKGFADVAKAEAHGFKVTDVAATVKGADLVMILIPDEFQSQLYKNEIEPNIKKGATLAFSHGFAIHYNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 381 - protein, 338 aa, Artificial sequence
  KARI variant 85054
MKVFYDKDCDLSIIQGKKVAIIGFGSQGHAQALNLKDSGVDVTVGLPKGFADVAKAEAHGFKVTDVAATVAGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 382 - protein, 338 aa, Artificial sequence
  KARI variant 85055
MKVFYDKDCDLSIIQGKKVAIIGFGSQGHAQALNLKDSGVDVTVGLPKGFADVAKAEAHGFKVTDVAAAVKGADLVMILIPDEFQSQLYKNEIEPNIKKGATLAFSHGFAIHFNQVVPRADLDVIMIAPKAPGHTVRSEFVKGGGIPDLIAVYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEFAKMFISEGATGYPSMTAKRRNNAAHGIEIIGEQLRSMMPWIGANKIVDKRKN

SEQ ID NO: 383 - DNA, 1017 bp, Artificial sequence
  coding sequence for variant R8-SOG1_y2
atgaaggttttctacgacaaggattgtgacttgtctatcattcaaggtaaaaaggtcgccatcatcggttttggttcccaaggtcacgctcaagccttgaacttaaaggactctggtgtcgatgttaccgtcggtctaccaaagggtttcgctgacgttgccaaggccgaagctcacggtttcaaggttactgacgtcgccgaagccgttgctggtgctgatttggtcatgatcctaattccagacgaattccaatcccaattgtacaaaaacgaaatcgaaccaaacatcaaaaagggtgccactttggctttctcccacggtttcgctatccactacaaccaagttgttccaagagctgacttggacgttatcatgattgctcctaaggctccaggtcataccgttagatctgaattcgtcaagggtggtggtatcccagacttgattgctgtttaccaagacgtttctggtaatgccaaaaacgtcgctttgtcctacgctgccggtgttggtggtggtcgtactggtatcatcgaaactaccttcaaggacgaaaccgaaaccgacttattcggtgaacaagctgttttgtgtggtggtaccgtcgaattggtcaaggctggttttgaaactttggtcgaagctggttacgctccagaaatggcttacttcgaatgtttacacgaattgaagttgattgttgatttgatgtacgaaggtggtattgctaacatgaactactctatctctaacaacgctgaatacggtgaatacgttactggtccagaagtcattaacgccgaatctagacaagctatgagaaatgctttgaagagaattcaagatggtgaattcgctaagatgttcatctctgaaggtgctaccggttacccttctatgactgctaagcgtagaaacaacgctgctcacggtatcgaaatcatcggtgaacaactaagatccatgatgccatggattggtgctaacaagatcgtcgataagagaaaaaactga

SEQ ID NO: 384 - DNA, 34 bp, Artificial sequence; identical to SEQ ID NO: 325
  Primer oBP562

SEQ ID NO: 385 - DNA, 49 bp, Artificial sequence; identical to SEQ ID NO: 326
  Primer oBP563

SEQ ID NO: 386 - DNA, 49 bp, Artificial sequence; identical to SEQ ID NO: 327
  Primer oBP564

SEQ ID NO: 387 - DNA, 34 bp, Artificial sequence; identical to SEQ ID NO: 328
  Primer oBP565

SEQ ID NO: 388 - skipped

SEQ ID NO: 389 - DNA, 8366 bp, Artificial sequence
  Synthetic construct-pRS316-UAS(PGK1)-pFBA2-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 390 - DNA, 1647 bp, Artificial sequence; identical to SEQ ID NO: 340
  kivD coding region from Listeria grayi codon optimized for expression in Saccharomyces cerevisiae

SEQ ID NO: 391 - DNA, 60 bp, Artificial sequence
  Primer oBP830
tatttaataataaaaatcataaatcataagaaattcgcttaagagttttgcttagataag

What is claimed is:

1. A polypeptide having ketol-acid reductoisomerase activity, wherein the polypeptide comprises
   a. the amino acid sequence of SEQ ID NO: 41;
   b. at least 99% identity to SEQ ID NO: 41;
   c. at least 99% identity to SEQ ID NO: 41 and at least one of the following substitutions: M301I, Y239H, Y113F, S322A, A71K, N114G, A329R, A69T, N114S, G72W, A295V, E264K, R280D, A329E, S157T, M238I, Q272T, K335M, R280H, and a combination thereof; or
   d. an active fragment of any one of (a) to (c).

2. The polypeptide of claim 1, further comprising a substitution at at least one of position L33, P47, F50, F61, I80, and V156.

3. The polypeptide of claim 1 further comprising at least one of the following substitutions: I13L, P47Y, F50A, V53A, S86A, A268E, V76I, L88V, and a combination thereof.

4. A recombinant microbial host cell comprising the polypeptide of claim 1.

5. The recombinant microbial host cell of claim 4 wherein said host cell further comprises reduced or eliminated acetolactate reductase activity.

6. The recombinant microbial host cell of claim 5 wherein said host cell further comprises at least one deletion, mutation, and/or substitution in fra2.

7. The recombinant microbial host cell of claim 4 further comprising the substrate to product conversions:
   a. pyruvate to acetolactate
   b. 2,3-dihydroxyisovalerate to α-ketoisovalerate
   c. α-ketoisovalerate to isobutyraldehyde; and
   d. isobutyraldehyde to isobutanol.

8. The recombinant microbial host cell of claim 4 wherein said host cell is a yeast host cell.

9. The recombinant microbial host cell of claim 8 wherein said host cell is *Saccharomyces cerevisiae*.

10. A method for converting acetolactate to dihydroxyisovalerate comprising:
 a. providing a microbial host cell comprising a polypeptide of claim 1;
 b. contacting the polypeptide with acetolactate wherein dihydroxyisovalerate is produced.

11. A method of producing a product selected from the group consisting of isobutanol, pantothenate, valine, leucine, isoleucine, 3, 3-dimethylmalate, and 2-methyl- 1-butanol or combinations thereof comprising:
 a. providing the recombinant host cell of claim 4 wherein the recombinant host cell comprises a product biosynthetic pathway; and
 b. contacting the microbial host cell with a carbon substrate under conditions whereby the product is produced.

12. The method of claim 11 wherein at least a portion of the contacting occurs under anaerobic conditions.

\* \* \* \* \*